(12) United States Patent
Higginson-Scott et al.

(10) Patent No.: US 12,129,499 B2
(45) Date of Patent: Oct. 29, 2024

(54) PROTEASE VARIANTS AND USES THEREOF

(71) Applicant: Seismic Therapeutic, Inc., Cambridge, MA (US)

(72) Inventors: Nathan Higginson-Scott, Hingham, MA (US); Nathan Rollins, Boston, MA (US); Jordan Anderson, Cambridge, MA (US); Alex Pellerin, Boston, MA (US); Ryan Peckner, Berkeley, CA (US); Yi Xing, Andover, MA (US); Ivan Mascanfroni, Worcester, MA (US); Kevin Lewis Otipoby, Ashland, MA (US); Yanfeng Zhou, Boxborough, MA (US)

(73) Assignee: Seismic Therapeutic, Inc., Watertown, MA (US)

( * ) Notice: Subject to any disclaimer, the term of this patent is extended or adjusted under 35 U.S.C. 154(b) by 0 days.

(21) Appl. No.: 18/405,861

(22) Filed: Jan. 5, 2024

(65) Prior Publication Data

US 2024/0229002 A1  Jul. 11, 2024

(51) Int. Cl.
*C12N 9/64* (2006.01)
*A61K 38/00* (2006.01)
*A61P 37/06* (2006.01)

(52) U.S. Cl.
CPC ............ *C12N 9/641* (2013.01); *A61P 37/06* (2018.01); *A61K 38/00* (2013.01); *C07K 2319/30* (2013.01); *C07K 2319/50* (2013.01)

(58) Field of Classification Search
CPC ......... C12N 9/641; A61P 37/06; A61K 38/00; C07K 2319/30; C07K 2319/50
See application file for complete search history.

(56) References Cited

U.S. PATENT DOCUMENTS

| | | | |
|---|---|---|---|
| 7,666,582 B2 | 2/2010 | Pawel-Rammingen et al. |
| 8,133,483 B2 | 3/2012 | Bjorck et al. |
| 8,552,158 B2 | 10/2013 | Fischer et al. |
| 8,563,691 B2 | 10/2013 | LeBowitz et al. |
| 8,691,544 B2 | 4/2014 | Nilsson |
| 8,785,168 B2 | 7/2014 | LeBowitz et al. |
| 9,408,897 B2 | 8/2016 | Levinson et al. |
| 9,469,683 B2 | 10/2016 | LeBowitz et al. |
| 9,549,974 B2 | 1/2017 | Leenhouts et al. |
| 9,861,686 B2 | 1/2018 | Porgador et al. |
| 9,964,548 B2 | 5/2018 | Magnelli et al. |
| 10,696,959 B2 | 6/2020 | Kjellman et al. |
| 10,758,597 B2 | 9/2020 | Kjellman et al. |
| 10,973,889 B2 | 4/2021 | Kjellman et al. |
| 11,214,784 B2 | 1/2022 | Kjellman et al. |
| 11,524,057 B2 | 12/2022 | Kjellman et al. |
| 11,667,905 B2 | 6/2023 | Kjellman et al. |
| 2006/0140907 A1 | 6/2006 | Blumberg et al. |
| 2010/0261216 A1 | 10/2010 | Eser et al. |
| 2011/0223147 A1 | 9/2011 | Lebowitz et al. |
| 2015/0139984 A1 | 5/2015 | Brezski et al. |
| 2017/0007680 A1 | 1/2017 | LeBowitz et al. |
| 2018/0125949 A1 | 5/2018 | LeBowitz et al. |
| 2018/0164325 A1 | 6/2018 | Koll et al. |
| 2019/0002542 A1 | 1/2019 | Wang et al. |
| 2019/0144528 A1 | 5/2019 | Paul et al. |
| 2019/0262434 A1 | 8/2019 | Brown |
| 2019/0309277 A1 | 10/2019 | James et al. |
| 2020/0378982 A1 | 12/2020 | Ohta et al. |
| 2021/0015910 A1 | 1/2021 | Seele et al. |
| 2021/0040463 A1 | 2/2021 | Chu et al. |
| 2021/0163923 A1 | 6/2021 | McCafferty et al. |
| 2021/0260173 A1 | 8/2021 | Nellman et al. |
| 2022/0133864 A1 | 5/2022 | Kishimoto |
| 2022/0135677 A1 | 5/2022 | Van Eenennaam et al. |
| 2023/0302100 A1 | 9/2023 | Kjellman et al. |

FOREIGN PATENT DOCUMENTS

| | | |
|---|---|---|
| EP | 1276895 B1 | 3/2010 |
| EP | 1625393 B1 | 10/2010 |
| EP | 2279210 A2 | 2/2011 |
| EP | 2225273 B1 | 5/2012 |
| EP | 2059530 B1 | 8/2012 |
| EP | 2394173 B1 | 3/2015 |
| EP | 3075386 A1 | 10/2016 |
| EP | 3149034 A2 | 4/2017 |
| EP | 2788017 B1 | 5/2017 |
| EP | 3187508 A1 | 7/2017 |
| EP | 3272773 A1 | 1/2018 |
| EP | 3517623 A1 | 7/2019 |
| EP | 3148576 B1 | 10/2020 |

(Continued)

OTHER PUBLICATIONS

Kizer, Lance, et al. "Application of functional genomics to pathway optimization for increased isoprenoid production." Applied and environmental microbiology 74.10 (2008): 3229-3241. (Year: 2008).*
Prather, Kristala L. Jones, and Collin H. Martin. "De novo biosynthetic pathways: rational design of microbial chemical factories." Current opinion in biotechnology 19.5 (2008): 468-474 (Year: 2008).*
K Singh, Raushan, et al. "Protein engineering approaches in the post-genomic era." Current Protein and Peptide Science 19.1 (2018): 5-15 (Year: 2018).*
Zhang, Meiling, David A. Case, and Jeffrey W. Peng. "Propagated perturbations from a peripheral mutation show interactions supporting WW domain thermostability." Structure 26.11 (2018): 1474-1485. (Year: 2018).*

(Continued)

*Primary Examiner* — Paul J Holland
*Assistant Examiner* — Erica Nicole Jones-Foster
(74) *Attorney, Agent, or Firm* — Goodwin Procter LLP

(57) ABSTRACT

Embodiments provided herein, provide for polypeptides and molecules comprising a polypeptide having protease activity and a variant Fc molecule, pharmaceutical compositions comprising the same, and methods that can be used to treat disorders, such as IgG mediated disorders.

25 Claims, 12 Drawing Sheets

Specification includes a Sequence Listing.

(56) References Cited

FOREIGN PATENT DOCUMENTS

| EP | 3256580 B1 | 7/2022 |
|---|---|---|
| EP | 4108768 A1 | 12/2022 |
| EP | 3256579 B1 | 8/2023 |
| WO | 2009075646 A1 | 6/2009 |
| WO | 2016128559 A1 | 8/2016 |
| WO | 2020073553 A1 | 4/2020 |
| WO | 2021021989 A1 | 2/2021 |
| WO | 2022031710 A2 | 2/2022 |
| WO | 2023116817 A1 | 6/2023 |
| WO | 2023175498 A1 | 9/2023 |
| WO | 2024008943 A1 | 1/2024 |
| WO | 2024036324 A1 | 2/2024 |

OTHER PUBLICATIONS

Karlsson et al. (2018, Date Published: Mar. 6, 2018, Molecular & Cellular Proteomics) {herein Karlsson} (Year: 2018).*

Agniswamy, et al., "Crystal structure of group A *Streptococcus* Mac-1: insight into dimer-mediated specificity for recognition of human IgG", Structure, Feb. 2006, vol. 14 (2): pp. 225-235. doi: 10.1016/j.str.2005.10.012.

Hulting, et al., "Two novel IgG endopeptidases of *Streptococcus equi*", FEMS Microbiol. Lett., Sep. 2009, vol. 298(1): pp. 44-50. doi: 10.1111/j. 1574-6968.2009.01698.x.

Ishihara, et al., "Dentipain, a *Streptococcus pyogenes* IdeS protease homology, is a novel virulence factor of Treponema denticola", Bio Chem, Sep. 2010, vol. 391 (9): pp. 1047-1055. doi: 10.1515/BC.2010.113.

Persson, et al., "Proteolytic processing of the *treptococcal* IgG endopeptidase IdeS modulates the functional properties of the enzyme and results in reduced immunorecognition", Molecular Immunology, Dec. 2015, vol. 68 (2 Pt A): pp. 176-184. Epub Sep. 2015. doi: 10.1016/j.molimm.2015.07.014.

Vindebro, et al., "Rapid IgG heavy chain cleavage by the *Streptococcal* IgG endopeptidase IdeS is mediated by IdeS monomers and is not due to enzyme dimerization", FEBS Lett., Jun. 2013, vol. 587 (12): pp. 1818-1822. Epub May 2013. doi: 10.1016/j.febslet.2013.04.039.

Wenig, et al., "Structure of the *Streptococcal* endopeptidase IdeS, a cysteine proteinase with strict specificity for IgG", Proc Natl Acad Sci USA, Dec. 2004, vol. 101 (50): pp. 17371-17376. Epub Dec. 2004. doi: 10.1073/pnas.0407965101.

Xie, Xingang et al., Chimeric Fusion between Clostridium Ramosum IgA Protease and IgG Fc Provides Long-Lasting Clearance of IgA Deposits in Mouse Models of IgA Nephropathy. Journal of the American Society of Nephrology, 33:5 (2022).

Saltzman A., Deep Mutational Scanning to Identify IgG1 Fc Mutations Affecting its Affinity to EndoS2 [bachelor's thesis]. Emory University; May 2, 2023. 43 p.

PCT/US2023/080313—International Search Report and Written Opinion, Apr. 23, 2023, 19 pages.

* cited by examiner

```
SEQ_ID_NO: 35    MRKRCYSTSAAVLAAVTLFVLSVDRGVIADSFSANQEIRYSEVTPYHVTISVWTKGVTPPA  60
SEQ_ID_NO: 1303  ------------------------------------------VTSVWTKGVTPPT       13
                                                           ************:

SEQ_ID_NO: 35    NFTQGEDVFHAPYVANQGWYDITKTFNGKDDLLCGAATAGNMLHWWFDQNKDQIKRYLEE  120
SEQ_ID_NO: 1303  DFIYGEDVLHAPYKAGQGWYDITKLFNGKDDLLCGAATAGNMLHWWFDQNKEQIKNYLKK   73
                  :* ****:****.* *:****** *********************:***::**:

SEQ_ID_NO: 35    HPEKQKINFNGEQMFDVKEAIDTKNHQLDSKLFEYFEKAFPYLSTKHLGVFPDHVIDMF  180
SEQ_ID_NO: 1303  YPEKQKINFGGEQLFDVKEAIDTKDSQLDSKLFDYFEKAFPYLSTKHLGVFPDHVIDMF  133
                 :******* ***:**********: :******:**************************

SEQ_ID_NO: 35    INGYRLSLTNHGPTPVKEGSKDPRGGIEDAVETRGDQSKLLTSRHDFEKNLKEISDLIK  240
SEQ_ID_NO: 1303  INGYRLSLTDHGPTPVKRGSKDPRGGIEDAVETRGDQSKLLTNRYDLKEKTLKEISDLIK  193
                 *********:******* ***********************.*:*:.*:.********

SEQ_ID_NO: 35    KELTEGKALGLSHTYANVRINHHVINLWGADFDSNGNLKAIYVTDSDSNASIGMKKYFVGV  300
SEQ_ID_NO: 1303  QELTEGKALGISHTYANVRIGHVINLWGADFDAEGNLEAIYVTDSDSNPSIGMKKYFVGV  253
                 :*********:.******** **********::.*** *********.***********

SEQ_ID_NO: 35    NSAGKVAISAKEIKEDNIGAQVLGLFTLSTGQDSWNQTN  339
SEQ_ID_NO: 1303  NSSGKVAISAKEIEEDNIGAQVLGLFTLSTGQDIWNQTN  292
                 **:**********:******************* *****
```

FIG. 9

PROTEASE VARIANTS AND USES THEREOF

CROSS-REFERENCE TO RELATED APPLICATIONS

This application claims priority to U.S. Provisional Application No. 63/478,789, filed Jan. 6, 2023, U.S. Provisional Application No. 63/483,142, filed Feb. 3, 2023, U.S. Provisional Application No. 63/493,450, filed Mar. 31, 2023, U.S. Provisional Application No. 63/506,539, filed Jun. 6, 2023, and U.S. Provisional Application No. 63/600,157, filed Nov. 17, 2023, each of which is hereby incorporated by reference in its entirety.

REFERENCE TO SEQUENCE LISTING SUBMITTED ELECTRONICALLY

The instant application contains a Sequence Listing which has been submitted electronically in XML file format and is hereby incorporated by reference in its entirety. Said XML copy, created on Jan. 4, 2024, is named "SES-007US_SE-Q.XML" and is 1,635,203 bytes in size.

FIELD

The embodiments provided herein relate to polypeptides comprising a polypeptide having protease activity and an Fc moiety, and compositions comprising the same.

BACKGROUND

Immunoglobulin G-degrading enzyme of *S. pyogenes* (IdeS) is an extracellular cysteine protease produced by the human pathogen *S. pyogenes*. IdeS has an extraordinarily high degree of substrate specificity, with its only identified substrate being immunoglobulin G (IgG). IdeS catalyzes a single proteolytic cleavage in the lower hinge region of the heavy chains of all subclasses of human IgG. IdeS also catalyzes an equivalent cleavage of the heavy chains of some subclasses of IgG in various animals. IdeS efficiently cleaves IgG to Fc and F(ab')2 fragments. IdeS is a virulence factor of *S. pyogenes*, which is responsible for common infections like tonsillitis and strep throat. To date, IdeS-Fc molecules resistant to autocleavage have not been available. Pathogenic IgG antibodies constitute an important clinical problem contributing to the pathogenesis of a number of autoimmune conditions and acute transplant rejection. To be able to effectively reduce, or eliminate such antibodies is therefore an important clinical challenge. The embodiments provided for herein fulfill this need as well as others.

BRIEF DESCRIPTION OF DRAWINGS

FIG. 9 illustrates the alignment of non-limiting protease variant to wild-type protease sequence.

DETAILED DESCRIPTION

Figure 1:
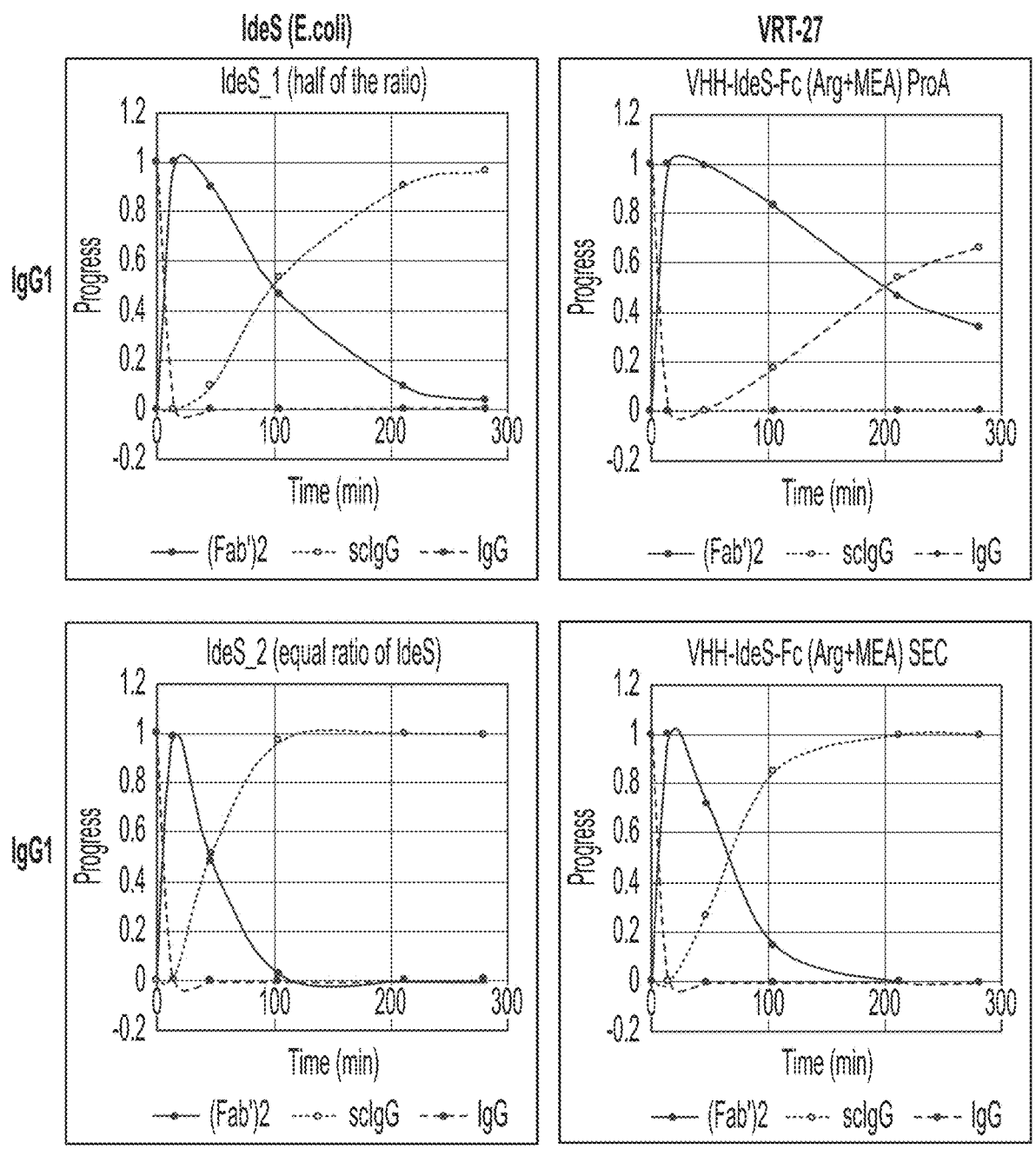
FIG. 1 illustrates performance of IdeS-Fc polypeptide against IdeS.

As used herein and in the appended claims, the singular forms "a", "an" and "the" include plural reference unless the context clearly dictates otherwise.

As used herein, the term "about" means that the numerical value is approximate and small variations would not significantly affect the practice of the disclosed embodiments. Where a numerical limitation is used, unless indicated otherwise by the context, "about" means the numerical value can vary by ±5% and remain within the scope of the disclosed embodiments. Thus, about 100 means 95 to 105.

As used herein, the term "animal" includes, but is not limited to, humans and non-human vertebrates such as wild, domestic, and farm animals. As used herein, the term "mammal" means a rodent (i.e., a mouse, a rat, or a guinea pig), a monkey, a cat, a dog, a cow, a horse, a pig, or a human. In some embodiments, the mammal is a human.

As used herein, the term "contacting" means bringing together of two elements in an in vitro system or an in vivo system. For example, "contacting" a therapeutic compound with an individual or patient or cell includes the administration of the compound to an individual or patient, such as a human, as well as, for example, introducing a compound into a sample containing a cellular or purified preparation containing target.

As used herein, the terms "comprising" (and any form of comprising, such as "comprise", "comprises", and "comprised"), "having" (and any form of having, such as "have" and "has"), "including" (and any form of including, such as "includes" and "include"), or "containing" (and any form of containing, such as "contains" and "contain"), are inclusive or open-ended and do not exclude additional, unrecited elements or method steps. Any composition or method that recites the term "comprising" should also be understood to also describe such compositions as consisting, consisting of, or consisting essentially of the recited components or elements.

As used herein, the term "fused" or "linked" when used in reference to a protein or molecule having different domains or heterologous sequences means that the protein domains are part of the same peptide chain that are connected to one another with either peptide bonds or other covalent bonding. The domains or section can be linked or fused directly to one another or another domain or peptide sequence can be between the two domains or sequences and such sequences would still be considered to be fused or linked to one another.

As used herein, the term "individual," "subject," or "patient," used interchangeably, means any animal, including mammals, such as mice, rats, other rodents, rabbits, dogs, cats, swine, cattle, sheep, horses, or primates, such as humans.

As used herein, the term "inhibit" refers to a result, symptom, or activity being reduced as compared to the activity or result in the absence of the compound that is inhibiting the result, symptom, or activity. In some embodiments, the result, symptom, or activity, is inhibited by about, or, at least, 10%, 20%, 30%, 40%, 50%, 60%, 70%, 80%, 90%, 95%, or 99%. An result, symptom, or activity can also be inhibited if it is completely elimination or extinguished.

As used herein, the phrase "in need thereof" means that the subject has been identified as having a need for the particular method or treatment. In some embodiments, the identification can be by any means of diagnosis. In any of the methods and treatments described herein, the subject can be in need thereof. In some embodiments, the subject is in an environment or will be traveling to an environment in which a particular disease, disorder, or condition is prevalent.

As used herein, the phrase "integer from X to Y" means any integer that includes the endpoints. For example, the phrase "integer from 1 to 5" means 1, 2, 3, 4, or 5.

As used herein, the phrase "ophthalmically acceptable" means having no persistent detrimental effect on the treated eye or the functioning thereof, or on the general health of the subject being treated. However, it will be recognized that transient effects such as minor irritation or a "stinging" sensation are common with topical ophthalmic administration of drugs and the existence of such transient effects is not inconsistent with the composition, formulation, or ingredient (e.g., excipient) in question being "ophthalmically acceptable" as herein defined. In some embodiments, the pharmaceutical compositions can be ophthalmically acceptable or suitable for ophthalmic administration.

In some embodiments, the term "therapeutic molecule" can be used interchangeably with "therapeutic compound," "molecule," or "therapeutic," and refers to any polypeptide, or protein described herein.

As used herein, the term "position," is meant to refer to a location in the sequence of a polypeptide. Positions may be numbered sequentially, or according to an established format, for example the EU numbering system based on Kabat's amino acid positions. For example, position 298 is a position in the human antibody IgG1.

"Specific binding" or "specifically binds to" or is "specific for" a particular antigen, target, or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen, target, or an epitope can be exhibited, for example, by an antibody having a $K_D$ for an antigen or epitope of at least about $10^{-4M}$, at least about $10^{-5M}$, at least about $10^{-6M}$, at least about $10^{-7M}$, at least about $10^{-8M}$, at least about $10^{-9M}$, alternatively at least about $10^{-10M}$ at least about $10^{-11M}$ at least about $10^{-12M}$, or greater, where $K_D$ refers to a dissociation rate of a particular antibody-target interaction. Typically, an antibody that specifically binds an antigen or target will have a $K_D$ that is, or at least, 2-, 4-, 5-, 10-, 20-, 50-, 100-, 500-, 1000-, 5,000-, 10,000-, or more times greater for a control molecule relative to the antigen or epitope.

In some embodiments, specific binding for a particular antigen, target, or an epitope can be exhibited, for example, by an antibody having a $K_A$ or $K_a$ for a target, antigen, or epitope of at least 2-, 4-, 5-, 20-, 50-, 100-, 500-, 1000-, 5,000-, 10,000- or more times greater for the target, antigen, or epitope relative to a control, where $K_A$ or $K_a$ refers to an association rate of a particular antibody-antigen interaction.

As provided herein, the compounds and compositions provided for herein can be used in methods of treatment as provided herein. As used herein, the terms "treat," "treated," or "treating" mean both therapeutic treatment and prophylactic measures wherein the object is to slow down (lessen) an undesired physiological condition, disorder or disease, or obtain beneficial or desired clinical results. For purposes of these embodiments, beneficial or desired clinical results include, but are not limited to, alleviation of symptoms; diminishment of extent of condition, disorder or disease; stabilized (i.e., not worsening) state of condition, disorder or disease; delay in onset or slowing of condition, disorder or disease progression; amelioration of the condition, disorder or disease state or remission (whether partial or total), whether detectable or undetectable; an amelioration of at least one measurable physical parameter, not necessarily discernible by the patient; or enhancement or improvement of condition, disorder or disease. Treatment includes eliciting a clinically significant response without excessive levels of side effects. Treatment also includes prolonging survival, as applicable for a specific disease, as compared to expected survival if not receiving treatment. Thus, "treatment of an autoimmune condition" or "treating autoimmunity" means an activity that alleviates or ameliorates any of the primary phenomena or secondary symptoms associated with the autoimmune condition other condition described herein when the terms "treat," "treated," or "treating" are used in conjunction with such condition.

As used herein, terms "variant," "molecule," "therapeutic," "therapeutic compound," "compound," "polypeptide," or "protein" can be used interchangeably and relate to the variants, molecules, therapeutics, therapeutic compounds, compounds, polypeptides, and proteins disclosed herein.

Variant Fc Molecules

As used herein, "isotype" refers to the immunoglobulin class (e.g., IgG1, IgG2, IgG3, IgG4, IgM, IgA1, IgA2, IgD, and IgE antibody) that is encoded by the heavy chain constant domain genes. The full-length amino acid sequence of each wild type human IgG constant region (including all domains, i.e., CH1 domain, hinge, CH2 domain, and CH3 domain) is cataloged in the UniProt database available on-line, e.g., as P01857 (IgG1), P01859 (IgG2), P01860 (IgG3), and P01861 (IgG4), or different allotypes thereof (SEQ ID NOs: 1, 2, 3, and 4, respectively). As used herein, a domain of a heavy chain constant region, e.g., the hinge, is of an "IgG1 isotype," "IgG2 isotype," "IgG3 isotype," or "IgG4 isotype," if the domain comprises the amino acid sequence of the corresponding domain of the respective isotype, or a variant thereof (that has a higher homology to the corresponding domain of the respective isotype than it does to that of the other isotypes).

"Allotype" refers to naturally occurring variants within a specific isotype group, which variants differ in a few amino acids (see, e.g., Jefferies et al. (2009) mAbs 1:1). Molecules described herein may be of any allotype.

A "wild-type" protein or portion thereof is a version of the protein as it is found in nature. An amino acid sequence of a wild-type protein, e.g., a heavy chain constant region, is the amino acid sequence of the protein as it occurs in nature. Due to allotypic differences, there can be more than one amino acid sequence for a wild-type protein. For example, there are several allotypes of naturally occurring human IGg1 heavy chain constant regions (e.g., Jeffries et al. (2009) mAbs 1:1).

As used herein, the term "chemical liabilities" is meant to refer to factors that impact a molecule's immunogenicity. Thus, in some embodiments, "chemical liabilities" is meant to refer to, without limitation, post-translational modifications, aggregation, glycosylation, impurities, or formulation components.

An immunoglobulin may be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In certain embodiments, the antibodies described herein are of the human IgG1 or IgG2 subtype. Immunoglobulins, e.g., human IgG1, exist in several allotypes, which differ from each other in at most a few amino acids.

In some embodiments, the IgG proteins (hinge region underlined) are as provided in Table 1.

TABLE 1

| Isotype | Sequence |
|---|---|
| IgG1 | ASTKGPSVFPLAPSSKSTSGGTAALGCLVKDYFPEPVTVSWNSGALTSGVHTFPAVLQSSGLYSLSSVVTVPSS SLGTQTYICNVNHKPSNTKVDKKVEPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLDSDGSFFLYSKLTVD KSRWQQGNVFSCSVMHEALHNHYTQKSLSLSPGK (SEQ ID NO: 1) |
| IgG2 | ASTKGPSVFPLAPCSRSTSESTAALGCLVKDYFPEPVTVSWNSGALTSGVHTFPAVLQSSGLYSLSSVVTVPSS NFGTQTYTCNVDHKPSNTKVDKTVERKCCVECPPCPAPPVAGPSVFLFPPKPKDTLMISRTPEVTCVVVDVSHE DPEVQFNWYVDGVEVHNAKTKPREEQFNSTFRVVSVLTVVHQDWLNGKEYKCKVSNKGLPAPIEKTISKTKGQP REPQVYTLPPSREEMTKNQVSLTCLVKGFYPSDISVEWESNGQPENNYKTTPPMLDSDGSFFLYSKLTVDKSRW QQGNVFSCSVMHEALHNHYTQKSLSLSPGK (SEQ ID NO: 2) |
| IgG3 | ASTKGPSVFPLAPCSRSTSGGTAALGCLVKDYFPEPVTVSWNSGALTSGVHTFPAVLQSSGLYSLSSVVTVPSS SLGTQTYTCNVNHKPSNTKVDKRVELKTPLGDTTHTCPRCPEPKSCDTPPPCPRCPEPKSCDTPPPCPRCPEPK SCDTPPPCPRCPAPELLGGPSVFLFPPKPKDTLMISRTPEVTCVVVDVSHEDPEVQFKWYVDGVEVHNAKTKPR EEQYNSTFRVVSVLTVLHQDWLNGKEYKCKVSNKALPAPIEKTISKTKGQPREPQVYTLPPSREEMTKNQVSLT CLVKGFYPSDIAVEWESSGQPENNYNTTPPMLDSDGSFFLYSKLTVDKSRWQQGNIFSCSVMHEALHNRFTQKS LSLSPGK (SEQ ID NO: 3) |
| IgG4 | ASTKGPSVFPLAPCSRSTSESTAALGCLVKDYFPEPVTVSWNSGALTSGVHTFPAVLQSSGLYSLSSVVTVPSS SLGTKTYTCNVDHKPSNTKVDKRVESKYGPPCPSCPAPEFLGGPSVFLFPPKPKDTLMISRTPEVTCVVVDVSQ EDPEVQFNWYVDGVEVHNAKTKPREEQFNSTYRVVSVLTVLHQDWLNGKEYKCKVSNKGLPSSIEKTISKAKGQ PREPQVYTLPPSQEEMTKNQVSLTCLVKGFYPSDIAVEWESNGQPENNYKTTPPVLDSDGSFFLYSRLTVDKSR WQEGNVFSCSVMHEALHNHYTQKSLSLSLGK (SEQ ID NO: 4) |

An "Fc region" (fragment crystallizable region) or "Fc polypeptide" or "Fc" refers to the C-terminal region of the heavy chain of an antibody that mediates the binding of the immunoglobulin to host tissues or factors, including binding to Fc receptors located on various cells of the immune system (e.g., effector cells) or to the first component (C1q) of the classical complement system. Thus, an Fc region of an antibody of isotype IgG comprises the heavy chain constant region of the antibody excluding the first constant region immunoglobulin domain (CH1). In IgG, IgA and IgD antibody isotypes, the Fc region comprises CH2 and CH3 constant domains in each of the antibody's two heavy chains; IgM and IgE Fc regions comprise three heavy chain constant domains (CH domains 2-4) in each polypeptide chain. For IgG, the Fc region comprises immunoglobulin domains consisting of the hinge, CH2 and CH3. For purposes herein, the Fc region is defined as starting at amino acid 216 and ending at amino acid 447, wherein the numbering is according to the EU index as in Kabat. Kabat et al. (1991) Sequences of Proteins of Immunological Interest, National Institutes of Health, Bethesda, MD, and according to FIGS. 3c-3f of U.S. Pat. App. Pub. No. 2008/0248028. In some embodiments, the Fc region comprises the hinge region. The Fc may be a native (or naturally-occurring or wild-type) Fc, including any allotypic variant, or a variant Fc (e.g., a non-naturally occurring Fc), comprising, e.g., 1, 2, 3, 4, 5, 1-5, 1-10 or 5-10 or more amino acid mutations, e.g., substitutions, additions or deletions. For example, a variant Fc may comprise an amino acid sequence that is at least 75%, 80%, 85%, 90%, 95%, 96%, 97%, 98% or 99% identical to a wild-type Fc. Modified or mutated Fcs may have enhanced or reduced effector function and/or half-life. Fc may refer to this region in isolation or in the context of an Fc-comprising protein polypeptide such as a "binding protein comprising an Fc region," also referred to as an "Fc fusion protein" (e.g., an antibody or immunoadhesin). In some embodiments, modified or variant Fc molecules have enhanced binding to FcγRIIb.

A "hinge", "hinge domain" or "hinge region" or "antibody hinge region" refers to the domain of a heavy chain constant region that joins the CH1 domain to the CH2 domain and includes the upper, middle, and lower portions of the hinge (Roux et al. J. Immunol. 1998 161:4083). The hinge provides varying levels of flexibility between the binding and effector regions of an antibody and also provides sites for intermolecular disulfide bonding between the two heavy chain constant regions. The term "hinge" includes wild-type hinges (such as those set forth in Table 3), as well as variants thereof (e.g., non-naturally-occurring hinges or modified hinges). For example, the term "IgG1 hinge" includes wild-type IgG1 hinge, as shown below, and variants having 1, 2, 3, 4, 5, 1-3, 1-5, 3-5 and/or at most 5, 4, 3, 2, or 1 mutations, e.g., substitutions, deletions or additions. In some embodiments, the hinge regions are as provided in Table 2.

TABLE 2

| Isotype | Hinge Sequence |
|---|---|
| IgG1 | EPKSCDKTHTCPPCPAPELLGGP (SEQ ID NO: 5) |
| IgG2 | ELKTPLGDTTHTCPRCPAPELLGGP (SEQ ID NO: 6) |
| IgG3 | ELKTPLGDTTHTCPRCPEPKSCDTPPPCPRCPEPKSCDTPPPCPRCPEPKSCDTPPPCPRCPAPEL LGGP (SEQ ID NO: 7) |
| IgG4 | ESKYGPPCPSCPAPEFLGGP (SEQ ID NO: 8) |

The term "CH1 domain" refers to the heavy chain constant region linking the variable domain to the hinge in a heavy chain constant domain. As used herein, a CH1 domain includes wild type CH1 domains, as well as variants thereof (e.g., non-naturally-occurring CH1 domains or modified CH1 domains). For example, the term "CH1 domain" includes wild-type CH1 domains and variants thereof having 1, 2, 3, 4, 5, 1-3, 1-5, 3-5 and/or at most 5, 4, 3, 2, or 1 mutations, e.g., substitutions, deletions or additions.

The term "CH2 domain" refers to the heavy chain constant region linking the hinge to the CH3 domain in a heavy chain constant domain. As used herein, a CH2 domain includes wild-type CH2 domains, as well as variants thereof (e.g., non-naturally-occurring CH2 domains or modified CH2 domains). For example, the term "CH2 domain" includes wild-type CH2 domains and variants thereof having 1, 2, 3, 4, 5, 1-3, 1-5, 3-5 and/or at most 5, 4, 3, 2, or 1 mutations, e.g., substitutions, deletions or additions.

The term "CH3 domain" refers to the heavy chain constant region that is C-terminus to the CH2 domain in a heavy chain constant domain. As used herein, a CH3 domain includes wild-type CH3 domains, as well as variants thereof (e.g., non-naturally-occurring CH3 domains or modified CH3 domains). For example, the term "CH3 domain" includes wild-type CH3 domains and variants thereof having 1, 2, 3, 4, 5, 1-3, 1-5, 3-5 and/or at most 5, 4, 3, 2, or 1 mutations, e.g., substitutions, deletions or additions.

Provided herein are variant Fc polypeptides comprising variant Fc polypeptides, e.g., Fc polypeptides that have a mutated sequence region, relative to wild-type Fc polypeptide. Exemplary variant Fc molecules comprising variant Fc polypeptides include an IgG1 hinge, a CH1 domain, a CH2 domain and a CH3 domain, wherein at least one of these constant domains has residues that are not wild-type residues, as compared to SEQ ID NO: 1, 2, 3, or 4. A variant Fc polypeptide may have effector function similar to that of wild-type IgG, or may be engineered to have enhanced effector function relative to that of the wild-type IgG. A variant Fc polypeptide may comprise a wild-type CH1, hinge, CH2 and/or CH3 domain, or a variant thereof, e.g., a CH1, hinge, CH2 and/or CH3 domain having one or more amino acid substitutions, deletions or additions relative to the corresponding wild-type domain, and/or having an amino acid sequence that is at least 70%, at least 75&, at least 80%, at least 85%, at least 90%, at least 91%, at least 92%, at least 93%, at least 94%, at least 95%, at least 96%, at least 97%, at least 98%, or at least 99% identical, or more, to the corresponding wild-type sequence.

In some embodiments, a variant Fc polypeptide comprises one or more mutations that confers resistance to recognition by a protease. In some embodiments, a variant Fc polypeptide comprises one or more mutations that confers resistance to proteolytic cleavage. In some embodiments, a variant Fc polypeptide comprises one or more mutations that confer resistance to recognition by a protease and proteolytic cleavage.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises an amino acid mutation at any one, or more, position between positions 234 and 329, as compared to SEQ ID NO: 1, wherein the mutation comprises an insertion, a deletion or a substitution.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a mutation corresponding to L234A mutation, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a mutation corresponding to L235A mutation, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a mutation corresponding to G237A mutation, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a mutation corresponding to Y296Q mutation, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a mutation corresponding to P329K mutation, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a set of mutations corresponding to L234A, L235A, and G237A mutations, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a set of mutations corresponding to Y296Q and P329K mutations, as compared to SEQ ID NO: 1.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 1, provided that the variant Fc polypeptide comprises a set of mutations corresponding to L234A, L235A, G237A, Y296Q, and P329K mutations, as compared to SEQ ID NO: 1.

In some embodiments, a variant Fc polypeptide comprises a mutation set of L234A, L235A, G237A, Y296Q, and P329K as compared to SEQ ID NO: 1, wherein the variant Fc polypeptide further comprises at least, about, or exactly 1-10, 1-20, 1, 2, 3, 4, 5, 6, 7, 8, 9, 10, 11, 12, 13, 14, 15, 16, 17, 18, 19 or 20 mutations in addition to the mutation set as compared to SEQ ID NO: 1.

TABLE 3

| ID | Fc Seq |
|---|---|
| VFC-1 | DKTHTCPPCPAPEAAGAPSVFLFPPKPKDTLMISRTPEVTCVVVDVSHEDPEVKENWYVDGVEVHNA KTKPREEQQNSTYRVVSVLTVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 19) |
| VFC-2 | DKTHTCPPCPAPEAAGAPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 20) |
| VFC-3 | DKTHTCPPCPAPEAAGAPSVFLFPPKPKDTLMISRTPEVTCVVVKVSHSDPEVKENWYVDGVEVHNA KTKPREEQQNSTYRVVSVLIVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 21) |
| VFC-4 | DKTHTCPPCPAPEAAGAPSVFLFPPKPKDTLMISRTPEVTCVVVKVSHSDPEVKENWYVDGVEVHNA KTKPREEQQNKTYRVVSVLTVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 22) |
| VFC-5 | DKTHTCPPCPAPEAAGAPSVFLFPPKPKDTLMISRTPEVTCVVVDVSHEDPEVKENWYVDGVEVHNA KTKPREEQQNSTYRVVSVLTVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPG (SEQ ID NO: 23) |
| VFC-6 | DKTHTCPPCPAPEAAGAPSVFLFPPKPKDTLMISRTPEVTCVVVDVSHEDPEVKENWYVDGVEVHNA KTKPREEQQNSTYRVVSVLTVLHQDWLNGKEYKCKVSNKALKAPIEKTISKAKGQPREPQVYTLPPS RDELTKNQVSLWCLVKGFYPSDIAVEWESNGQPENNYKTTPPVLDSDGSFFLYSKLTVDKSRWQQGN VFSCSVMHEALHNHYTQKSLSLSPG (SEQ ID NO: 24) |
| VFC-7 | DKTHTCPPCPAPEAAGAPSVFLFPPKPKDTLMISRTPEVTCVVVDVSHEDPEVKFNWYVDGVEVHNA KTKPREEQQNSTYRVVSVLTVLHQDWLNGKEYKCKVSNKALKAPIEKTISKAKGQPREPQVYTLPPS RDELTKNQVSLSCAVKGFYPSDIAVEWESNGQPENNYKTTPPVLDSDGSFFLVSKLTVDKSRWQQGN VFSCSVMHEALHNHYTQKSLSLSPG (SEQ ID NO: 25) |
| VFC-8 | DKTHTSPPCPAPEAAGAPSVFLFPPKPKDTLMISRTPEVTCVVVDVSHEDPEVKENWYVDGVEVHNA KTKPREEQQNSTYRVVSVLTVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 42) |
| VFC-9 | DKTHTSPPSPAPEAAGAPSVFLFPPKPKDTLMISRTPEVTCVVVDVSHEDPEVKENWYVDGVEVHNA KTKPREEQQNSTYRVVSVLTVLHQDWLNGKEYKCKVSNKALKAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 43) |
| VFC-10 | DKTHTCPPCPAPELLGDSGVFLFPPKPKDTLMISRTPEVTCVVVDVSHDEPEVKENWYVDGVEVHNA KTKPREEQYNSTYRVVSVLTVLHQDWLNGKEYKCKVSNKALPRPIEKTISKAKGQPREPQVYTLPPS RDELTKNQVSLWCLVKGFYPSDIAVEWESNGQPENNYKTTPPVLDSDGSFFLYSKLTVDKSRWQQGN VFSCSVMHEALHNHYTQKSLSLSPGK (SEQ ID NO: 44) |
| VFC-11 | DKTHTCPPCPAPEFEGGPSVFLFPPKPKDTLMISRTPEVTCVVVDVSDEDGEVKENWYVDGVEVHNA KTKPREEQYNSTYRVVSVLTVLHQDWLNGKEYKCKVSNKALAAPIEKTISKAKGQPREPQVYTLPPS RDELTKNQVSLSCAVKGFYPSDIAVEWESNGQPENNYKTTPPVLDSDGSFFLVSKLTVDKSRWQQGN VFSCSVMHEALHNHYTQKSLSLSPGK (SEQ ID NO: 45) |
| VFC-12 | DKTHTCPPCPAPEFEGGPSVFLFPPKPKDTLMISRTPEVTCVVVDVSQEDPEVQFNWYVDGVEVHNA KTKPREEQFNSTYRVVSVLTVLHQDWLNGKEYKCKVSNKALPSSIEKTISKAKGQPREPQVYTLPPS RDELTKNQVSLWCLVKGFYPSDIAVEWESNGQPENNYKTTPPVLDSDGSFFLYSKLTVDKSRWQQGN VFSCSVMHEALHNHYTQKSLSLSPGK (SEQ ID NO: 46) |
| VFC-13 | DKTHTCPPCPAPEFEGGPSVFLFPPKPKDTLMISRTPEVTCVVVDVSDEDGEVQFNWYVDGVEVHNA KTKPREEQFNSTYRVVSVLTVLHQDWLNGKEYKCKVSNKALASSIEKTISKAKGQPREPQVYTLPPS RDELTKNQVSLSCAVKGFYPSDIAVEWESNGQPENNYKTTPPVLDSDGSFFLVSKLTVDKSRWQQGN VFSCSVMHEALHNHYTQKSLSLSPGK (SEQ ID NO: 47) |
| VFC-14 | DKTHISPPCPAPEAAGAPSVFLFPPKPKDTLMISRTPEVTCVVVDVSHEDPEVKENWYVDGVEVHNA KTKPREEQYNSTYRVVSVLTVLHQDWLNGKEYKCKVSNKALPAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 48) |
| VFC-15 | DKTHISPPCPAPELLGGPSVFLFPPKPKDTLMISRTPEVTCVVVDVSHEDPEVKENWYVDGVEVHNA KTKPREEQYNSTYRVVSVLTVLHQDWLNGKEYKCKVSNKALPAPIEKTISKAKGQPREPQVYTLPPS RDELTKNQVSLTCLVKGFYPSDIAVEWESNGQPENNYKTTPPVLDSDGSFFLYSKLTVDKSRWQQGN VFSCSVMHEALHNHYTQKSLSLSPGK (SEQ ID NO: 49) |

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, 25, 42, 43, 44, 45, 46, 47, 48, or 49. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, provided that the variant Fc polypeptide comprises one or more mutations at position 234, 235, 237, 265, 269, 296, 298, 329, or any combination thereof. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, provided that the variant Fc polypeptide comprises one or more mutations at position 234, 235, 237, 265, 269, 296, 298, 329, or any combination thereof. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, provided that the variant Fc polypeptide comprises one or more mutations at position 234, 235, 237, 265, 269, 296, 298, 329, or any combination thereof.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations of L234A, L235A, G237A, Y296Q, P329K, or any combination thereof. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, provided that the variant Fc polypeptide comprises one or more mutations of L234A, L235A, G237A, Y296Q, P329K, or any combination thereof. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, provided that the variant Fc polypeptide comprises one or more mutations of L234A, L235A, G237A, Y296Q, P329K, or any combination thereof.

In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, provided that the variant Fc polypeptide comprises a set of mutations corresponding to L234A, L235A, G237A, Y296Q, and P329K mutations. In some embodiments, a variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, provided that the variant Fc polypeptide comprises a set of mutations corresponding to L234A, L235A, G237A, Y296Q, and P329K mutations.

In some embodiments, a variant Fc polypeptide comprises a mutation set of L234A, L235A, G237A, Y296Q, and P329K as compared to SEQ ID NO: 19, 20, 21, 22, 23, 24, or 25, wherein the variant Fc polypeptide further comprises at least, about, or exactly 1-10, 1-20, 1, 2, 3, 4, 5, 6, 7, 8, 9, 10, 11, 12, 13, 14, 15, 16, 17, 18, 19 or 20 mutations in addition to the L234A, L235A, G237A, Y296Q, and P329K mutation set as compared to SEQ ID NO: 19, 20, 21, 22, 23, 24, or 25. In some embodiments, a variant Fc polypeptide comprises a mutation set of L234A, L235A, G237A, Y296Q, and P329K as compared to SEQ ID NO: 23, wherein the variant Fc polypeptide further comprises at least, about, or exactly 1-10, 1-20, 1, 2, 3, 4, 5, 6, 7, 8, 9, 10, 11, 12, 13, 14, 15, 16, 17, 18, 19 or 20 mutations in addition to the L234A, L235A, G237A, Y296Q, and P329K mutation set as compared to SEQ ID NO: 23.

In some embodiments, a variant Fc polypeptide comprises an amino acid sequence as provided in Table 3. In some embodiments, a variant Fc polypeptide comprises an amino acid sequence of SEQ ID NO: 19, 20, 21, 22, 23, 24, 25, 42, 43, 44, 45, 46, 47, 48, or 49. In some embodiments, a variant Fc polypeptide comprises an amino acid sequence of SEQ ID NO: 19. In some embodiments, a variant Fc polypeptide comprises an amino acid sequence of SEQ ID NO: 20. In some embodiments, a variant Fc polypeptide comprises an amino acid sequence of SEQ ID NO: 21. In some embodiments, a variant Fc polypeptide comprises an amino acid sequence of SEQ ID NO: 22. In some embodiments, a variant Fc polypeptide comprises an amino acid sequence of SEQ ID NO: 23. In some embodiments, a variant Fc polypeptide comprises an amino acid sequence of SEQ ID NO: 24. In some embodiments, a variant Fc polypeptide comprises an amino acid sequence of SEQ ID NO: 25. In some embodiments, a variant Fc polypeptide comprises an amino acid sequence of SEQ ID NO: 42. In some embodiments, a variant Fc polypeptide comprises an amino acid sequence of SEQ ID NO: 43. In some embodiments, a variant Fc polypeptide comprises an amino acid sequence of SEQ ID NO: 44. In some embodiments, a variant Fc polypeptide comprises an amino acid sequence of SEQ ID NO: 45. In some embodiments, a variant Fc polypeptide comprises an amino acid sequence of SEQ ID NO: 46. In some embodiments, a variant Fc polypeptide comprises an amino acid sequence of SEQ ID NO: 47. In some embodiments, a variant Fc polypeptide comprises an amino acid sequence of SEQ ID NO: 48. In some embodiments, a variant Fc polypeptide comprises an amino acid sequence of SEQ ID NO: 49.

In some embodiments, a variant Fc polypeptide comprises an amino acid sequence having a C-terminal lysine (K). In some embodiments, a variant Fc polypeptide comprises an amino acid sequence not having a C-terminal lysine (K).

In some embodiments, the variant Fc polypeptide, such as those provided herein, is conjugated to another polypeptide. In some embodiments, the another polypeptide is an antibody. In some embodiments, the variant Fc polypeptide, such as those provided herein, is conjugated to an effector binding/modulating polypeptide or a tissue targeting polypeptide. In some embodiments, the variant Fc polypeptide, such as those provided herein, is conjugated to an antibody, or antigen-binding fragment thereof. In some embodiments, the variant Fc polypeptide, such as those, is conjugated to another polypeptide via a linker or a covalent bond. In some embodiments, the linker is a protein linker, such as those provided herein.

Protease Variants

The present disclosure provides for polypeptides, molecules, compounds, therapeutics, and compositions comprising a polypeptide having protease activity, which can be covalently or non-covalently connected to a Fc polypeptide domain, such as those provided for herein. In some embodiments, the polypeptide having protease activity is IdeS, IdeSsuis, IdeZ, IdeE, IdeE2, IdeZ2, or IdeC.

*Streptococcus pyogenes* is a significant bacterial pathogen that secretes two enzymes showing remarkable specificity for IgG; EndoS and IdeS. EndoS (Endoglycosidase in *Streptococcus pyogenes*) specifically hydrolyzes the functionally important N-linked glycan of IgG, and treatment with EndoS abrogates the pathogenic activity of IgG in mouse models of autoimmune disease. (Collin M, Olsén A. EndoS, a novel secreted protein from *Streptococcus pyogenes* with endoglycosidase activity on human IgG. Embo J. 2001; 20:3046-3055; Nandakumar K S, Collin M, Olsén A, Nimmerjahn F, Blom A M, et al. Endoglycosidase treatment abrogates IgG arthritogenicity: importance of IgG glycosylation in arthritis. Eur J Immunol. 2007; 37:2973-2982) IdeS (Immunoglobulin G-degrading enzyme of *Streptococcus pyogenes*) is a cysteine proteinase which cleaves IgG with a unique degree of specificity in the hinge region. (Wenig K, Chatwell L, von Pawel-Rammingen U, Björck L, Huber R, et al. Structure of the streptococcal endopeptidase IdeS, a cysteine proteinase with strict specificity for IgG. Proc Natl Acad Sci USA. 2004; 101:17371-17376) IdeS is extremely specific for IgG, which is hydrolyzed in the hinge region after glycine residue 236 in both heavy chains, which generates one F(ab')2 and two monomeric Fc fragments. IdeE is a homolog of the secreted IgG-specific protease IdeS/Mac of *Streptococcus pyogenes*. The activity of IdeE is comparable with the activity of IdeZ, the corresponding enzyme of the closely related *S. equi* ssp. *zooepidemicus*.

The full sequence of IdeS is publicly available as NCBI Reference Sequence no. WP_010922160.1 and is provided herein as SEQ ID NO: 35:

```
                                    (SEQ ID NO: 35)
MRKRCYSTSAAVLAAVTLFVLSVDRGVIADSFSANQEIRYSEVTPYHVT

SVWTKGVTPPANFTQGEDVFHAPYVANQGWYDITKTFNGKDDLLCGAAT

AGNMLHWWFDQNKDQIKRYLEEHPEKQKINFNGEQMFDVKEAIDTKNHQ
```

```
                                    -continued
LDSKLFEYFKEKAFPYLSTKHLGVFPDHVIDMFINGYRLSLINHGPTPV

KEGSKDPRGGIFDAVFTRGDQSKLLTSRHDFKEKNLKEISDLIKKELTE

GKALGLSHTYANVRINHVINLWGADFDSNGNLKAIYVTDSDSNASIGMK

KYFVGVNSAGKVAISAKEIKEDNIGAQVLGLFTLSTGQDSWNQTN.
```

This sequence includes an N-terminus methionine followed by a 28 amino acid secretion signal sequence. The N-terminus methionine and the signal sequence (a total of 29 amino acids at the N terminus) are typically removed to form the mature IdeS protein, the amino acid sequence of which is publicly available as UniProt Identifier Q9F1R7_STRPY and is provided herein as SEQ ID NO: 36. Another variant of an IdeS protease that can be used as a reference sequence can be as illustrated in SEQ ID NO: 1349, which is similar to the amino acid sequence of SEQ ID NO: 36, but has an additional 4 amino acid residues at the N-terminus, which are DSFS (SEQ ID NO: 1350).

IdeZ is an IgG cysteine protease produced by *Streptococcus equi* ssp. *zooepidemicus*, a bacterium predominantly found in horses. As IdeZ is not a human pathogen, human subjects do not typically have antibodies against this protein in their plasma. However, IdeZ has a level of IgG cysteine protease activity against human IgG which is considerably lower than that of IdeS. The full sequence of IdeZ is publicly available as UniProt Identifier Q0PIW1 and is provided herein as SEQ ID NO: 1331 below:

```
                                    (SEQ ID NO: 1331)
MKTIAYPNKPHSLSAGLLTAIAIFSLASSNITYADDYQRNAAEVYAKEV

PHQITSVWTKGVTPLTPEQFRYNNEDVIHAPYLAHQGWYDITKVFDGKD

NLLCGAATAGNMLHWWFDQNKTEIEAYLSKHPEKQKIIFNNQELFDLKA

AIDTKDSQINSQLENYFRDKAFPNLSARQLGVMPDLVLDMFINGYYLNV

FKTQSTDVNRPYQDKDKRGGIFDAVFTRGDQTTLLLTARHDLKNKGLNDI

STIIKQELTEGRALALSHTYANVSISHVINLWGADFNAEGNLEAIYVID

SDANASIGMKKYFVGINAHGHVAISAKKIEGENIGAQVLGLFTLSSGKD

IWQKLS.
```

In some embodiments, IdeZ is publicly available as NCBI Reference Sequence no WP_014622780.1 and is provided herein as SEQ ID NO: 1332 below:

```
                                    (SEQ ID NO: 1332)
MKTIAYPNKPHSLSAGLLTAIAIFSLASSNITYADDYQRNATEAYAKEV

PHQITSVWTKGVIPLIPEQFRYNNEDVIHAPYLAHQGWYDITKAFDGKD

NLLCGAATAGNMLHWWFDQNKTEIEAYLSKHPEKQKIIFNNQELFDLKA

AIDTKDSQINSQLENYFRDKAFPNLSARQLGVMPDLVLDMFINGYYLNV

FKIQSTDVNRPYQDKDKRGGIFDAVFIRGDQTILLLTARHDLKNKGLNDI

STIIKQELTEGRALALSHIYANVSISHVINLWGADFNAEGNLEAIYVID

SDANASIGMKKYFVGINAHGHVAISAKKIEGENIGAQVLGLFTLSSGKD

IWQKLS.
```

The mature sequence of IdeZ is publicly available as UniProt Identifier A0A0D0YKS5_STRSZ and is provided herein as SEQ ID NO: 38.

In some embodiments, the polypeptide having protease activity is IdeS, IdeSsuis, IdeZ, IdeE, IdeE2, IdeZ2, Ide85, or IdeC. In some embodiments, the IdeS, IdeZ, IdeE, IdeE2, IdeZ2, Ide85, or IdeC protease has an amino acid sequence such as those provided herein. The mature sequence of IdeSsuis is publicly available as UniProt Identifier C5W022 and is provided herein as SEQ ID NO: 55. The mature sequence of IdeE is publicly available as UniProt Identifier COM8U6_STRE4 and is provided herein as SEQ ID NO: 37. The mature sequence of IdeE2 is publicly available as UniProt Identifier C7B615_9STRE and is provided herein as SEQ ID NO: 39. The mature sequence of IdeZ2 is publicly available as UniProt Identifier B4U2F7_STREM and is provided herein as SEQ ID NO: 40. The mature sequence of IdeC is publicly available as UniProt Identifier A0A3P5YAY8_STRCB and is provided herein as SEQ ID NO: 41. In some embodiments, the protease is an IgG degrading protease. In some embodiments, the protease is an IgM degrading protease.

TABLE 4

| ID | Polypeptide having protease activity Seq |
|---|---|
| IdeS | ANQEIRYSEVTPYHVISVWTKGVTPPAQFTQGEDVFHAPYVANQGWYDITKTFNGKDDLLCGAAT AGNMLHWWFDQNKDQIKRYLEEHPEKQKINFNGEQMEDVKEAIDTKNHQLDSKLFEYFKEKAFPY LSTKHLGVPPDHVIDMFINGYRLSLTNHGPTPVKEGSKDPRGGIFDAVETRGDQSKLLTSRHDEK EKNLKEISDLIKKELTEGKALGLSHTYANVRINHVINLWGADFDSNGNLKAIYVTDSDSNASIGM KKYFVGVNSAGKVAISAKEIKEDNIGAQVLGLFTLSTGQDSWNQTN (SEQ ID NO: 26) |
| IdeS-Glycan | ANQEIRYSEVTPYHVTSVWTKNVTPPAQFTQGEDVFHAPYVANQGWYDITKTFNGKDDLLCGAAT AGNMLHWWFDQNKDQIKRYLEEHPEKQKINFNGSQMFDVKEAIDTKNHQLDSKLFEYFKEKAFPY LSTKHLGVPPDHVIDMFINGYRLSLNNSGPTPVKNGSKDPRGGIFDAVFTRGDQSKLLTSRHDFK NKSLKEISDLIKKELTEGKALGLSHTYANVRINHVINLWGADFDSNGTLKAIYVTDSDSNASIGM KKYFVGVNNATKVAISAKEIKENNTGAQVLGLFTLSTGQDSWNQTN (SEQ ID NO: 28) |
| IdeS-NAQ | ANQEIRYSEVTPYHVTSVWTKGVTPPAQFTQGEDVFHAPYVANQGWYDITKTFNGKDDLLCGAAT AGNMLHWWFDQNKDQIKRYLEEHPEKQKINFNGEQMFDVKEAIDTKNHQLDSKLFEYFKEKAFPY LSTKHLGVPPDHVIDMFINGYRLSLTNHGPTPVKEGSKDPRGGIFDAVFTRGDQSKLLTSRHDFK EKNLKEISDLIKKELTEGKALGLSHTYANVRINHVINLWGADFDSNGNLKAIYVTDSDSNAQIGM KKYFVGVNSAGKVAISAKEIKEDNIGAQVLGLFTLSTGQDSWNQTN (SEQ ID NO: 29) |
| IdeS-NAQ-G/S Linker | ANQEIRYSEVTPYHVTSVWTKGVTPPAQFTQGEDVFHAPYVANQGWYDITKTFNGKDDLLCGAAT AGNMLHWWFDQNKDQIKRYLEEHPEKQKINFNGEQMFDVKEAIDTKNHQLDSKLFEYFKEKAFPY LSTKHLGVPPDHVIDMFINGYRLSLINHGPTPVKEGSKDPRGGIFDAVFTRGDQSKLLTSRHDFK EKNLKEISDLIKKELTEGKALGLSHTYANVRINHVINLWGADFDSNGNLKAIYVTDSDSNAQIGM KKYFVGVNSAGKVAISAKEIKEDNIGAQVLGLFTLSTGQDSWNQTNGGGGS (C-terminus) (SEQ ID NO: 31) |
| IdeS variant | ANQEIRYSEVTPYHVTSVWTKGVTPPANFTQGEDVFHAPYVANQGWYDITKTENGKDDLLCGAAT AGNMLHWWFDQNKDQIKRYLEEHPEKQKINFNGEQMFDVKEAIDTKNHQLDSKLFEYFKEKAFPY LSTKHLGVPPDHVIDMFINGYRLSLTNHGPTPVKEGSKDPRGGIFDAVFTRGDQSKLLTSRHDFK EKNLKEISDLIKKELTEGKALGLSHTYANVRINHVINLWGADFDSNGNLKAIYVTDSDSNASIGM KKYFVGVNSAGKVAISAKEIKEDNIGAQVLGLFTLSTGQDSWNQTN (SEQ ID NO: 36) |
| IdeS variant | DSFSANQEIRYSEVTPYHVISVWTKGVTPPANFTQGEDVFHAPYVANQGWYDITKTFNGKDDLLC GAATAGNMLHWWFDQNKDQIKRYLEEHPEKQKINFNGEQMFDVKEAIDTKNHQLDSKLFEYFKEK AFPYLSTKHLGVFPDHVIDMFINGYRLSLTNHGPTPVKEGSKDPRGGIFDAVFTRGDQSKLLTSR HDFKEKNLKEISDLIKKELTEGKALGLSHTYANVRINHVINLWGADFDSNGNLKAIYVTDSDSNA SIGMKKYFVGVNSAGKVAISAKEIKEDNIGAQVLGLFTLSTGQDSWNQTN (SEQ ID NO: 1349) |
| IdeS-GlycanN42 | ANQEIRYSNVTPYHVTSVWTKGVTPPANFTQGEDVFHAPYVANQGWYDITKTFNGKDDLLCGAAT AGNMLHWWFDQNKDQIKRYLEEHPEKQKINFNGEQMFDVKEAIDTKNHQLDSKLFEYFKEKAFPY LSTKHLGVPPDHVIDMFINGYRLSLTNHGPTPVKEGSKDPRGGIFDAVFTRGDQSKLLTSRHDEK EKNLKEISDLIKKELTEGKALGLSHTYANVRINHVINLWGADFDSNGNLKAIYVTDSDSNASIGM KKYFVGVNSAGKVAISAKEIKEDNIGAQVLGLFTLSTGQDSWNQTN (SEQ ID NO: 50) |
| IdeS-Glycan N47N274 | ANQEIRYSEVTPYHNTSVWTKGVTPPANFTQGEDVFHAPYVANQGWYDITKTFNGKDDLLCGAAT AGNMLHWWFDQNKDQIKRYLEEHPEKQKINFNGEQMFDVKEAIDTKNHQLDSKLFEYFKEKAFPY LSTKHLGVPPDHVIDMFINGYRLSLTNHGPTPVKEGSKDPRGGIFDAVFTRGDQSKLLTSRHDFK EKNLKEISDLIKKELTEGKALGLSHTYANVRINHVINLWGADFDSNGSLKAIYVTDSDSNASIGM KKYFVGVNSAGKVAISAKEIKEDNIGAQVLGLFTLSTGQDSWNQTN (SEQ ID NO: 51) |
| IdeSsuis | DTVVTGVNEIIEESQVKDEVSIESEKNESLDGSNIEIVEEIADNIPSPVIAEGEVAVEMKVDRGT ENVVSRNDTEVTTSEQNQIEVTETKEILNQTSYQTESGEQRQIIWAHGITPPAMEQSGGFVKEKY GDYLNYTAPFEAGKGYYDTNKSLNASFIDLNLCFAAVSSNMVHWWLEQNSSYVERYLKEKKGTVN VEENYAITDLRRYINSFQNQQNSRVFDMFKTYYGYRINGFVSDALVDLFINGYKPKAQGGVNLED SQLVPDSRGGFFYDVFKEKKLTNRIFSGSYERFGEDVRTVLESKGLLGLTYRTLGYATHIVTWG AEYDNQGKIKAVYITDSDDQEQIGLKRMGITRDASGNPRLNNHMKNNSAGALLDYVHTIRLGQD LWEEYFNPLAKAKETASQTLADTKKALDLSIQGQSELPESMRLIYLEKLNNLYNQGILSIQKAES SEMLSGALENGLNSLKSLDFPISEVGNALAPDLPVGDRSTVSDVDSLSSQETSSTNLEADTENAG IIADGTNQLHFPVEAQTTSSVEAEGDNVFEQEADTLPIIIENKDEFGSELSRNMQTSETDSLVVA VEEDVKNDEVAQVEELLESEKVENQSSELLSDTLIVESANDKEEDRVEAVVSEQPDSIPHQNVEI SLVEPTNVETETVVTPINDAATPHGSPTYIDNSVTESVATPLEKDSIQAGETEIAEPTSSESTNV ETETVVTPVNDVATPHGSPTYIDNSVTESVATPLEKDSIQAGETEIAEPTSSESTNVETETVVTP VNDVATPHGSPTYIDNSVTESVATPLEKDSIQAGETEIAEPTSSESTSVEAELVDNSEIHAATSS VTPCGSSAYADGSTTESVATPLEKDSIQTGNTEIAEPTSSKSTNVEAASVDNSEIHADASLTAVS SVNLDNPVIEPVAISLIGSKRDTNAEVEVSSLSKREVRKTNTDGLISVQSKVIKKELLESSLAEA GSPLLEATIAQSSNSNSTEIGMSYQNTVLLESNNTERQVSKAEIVMEHKETELVETVSSASEPVV |

TABLE 4-continued

| ID | Polypeptide having protease activity Seq |
|---|---|
|  | LVENISQTSNNTIESGKNMGVQSQAGAKQILGVEQSSKVSTPTSRQIMGVGLLTLVLGSALGLLK KRRK (SEQ ID NO: 55) |
| IdeE | DDYQRNATEAYAKEVPHQITSVWTKGVTPLTPEQFRYNNEDVIHAPYLAHQGWYDITKAFDGKDN LLCGAATAGNMLHWWFDQNKTEIEAYLSKHPEKQKIIFNNQELFDLKAAIDTKDSQTNSQLFNYF RDKAFPNLSARQLGVMPDLVLDMFINGYYLNVFKTQSTDVNRPYQDKDKRGGIFDAVFTRGDQTT LLTARHDLKNKGLNDISTIIKQELTEGRALALSHTYANVSISHVINLWGADENAEGNLEAIYVTD SDANASIGMKKYFVGINAHRHVAISAKKIEGENIGAQVLGLFTLSSGKDIWQKLS (SEQ ID NO: 37) |
| IdeZ | DDYQRNATEAYAKEVPHQITSVWTKGVTPLTPEQFRYNNEDVIHAPYLAHQGWYDITKAFDGKDN LLCGAATAGNMLHWWFDQNKTEIEAYLSKHPEKQKIIFNNQELFDLKAAIDTKDSQTNSQLFNYF RDKAFPNLSARQLGVMPDLVLDMFINGYYLNVFKTQSTDVNRPYQDKDKRGGIFDAVFTRGDQTT LLTARHDLKNKGLNDISTIIKQELTEGRALALSHTYANVSISHVINLWGADFNAEGNLEAIYVTD SDANASIGMKKYFVGINAHGHVAISAKKIEGENIGAQVLGLFTLSSGKDIWQKLS (SEQ ID NO: 38) |
| IdeZ-V2 | RNATEAYAKEVPHQITSVWTKGVTPLTPEQFRYNNEDVIHAPYLAHQGWYDITKAFDGKDNLLCG AATAGNMLHWWFDQNKTEIEAYLSKHPEKQKIIFNNQELFDLKAAIDTKDSQTNSQLFNYFRDKA FPNLSARQLGVMPDLVLDMFINGYYLNVFKTQSTDVNRPYQDKDKRGGIFDAVFTRGDQTTLLTA RHDLKNKGLNDISTIIKQELTEGRALALSHTYANVSISHVINLWGADFNAEGNLEAIYVTDSDAN ASIGMKKYFVGINAHGHVAISAKKIEGENIGAQVLGLFTLSSGKDIWQKLS (SEQ ID NO: 52) |
| IdeE2 | EVVEVWPNGQNPNGKIEILSQTEHSEHLQKLRDIEDFQAQKQADHVRYTKWLDGVTVDEHEFRKI KEYDTEYYVTPLLSGKGYYDINKDFNQDSDKCAAAVAANMFHYWFDRNRDSINRFLSQSPGENGV IKLENEKTIEVSKFLETYRSDGDYLDKSPFFDLISNSFKGPVWANKLLDAYINGYGYIHKFAKNT PHSKNNNSKFNFFKKVFDGNLLTDIHQIFDYNTFSDKLSEALYTGKAIGLAYGPGDLRRSLGHII SVWGADLDDQNRVVAIYVTDSDDKKLTIGNERVGLKRYKVSSDDQGRARLITRDKDNTGGEIRSI ETLDMGTQEWADYENKTEK (SEQ ID NO: 39) |
| IdeZ2 | EVVEVWPYGQNPNGKTEILSQTEDSESLQRLRDIEDFQAEKKMQNVVYTKWLDGVDVKDHDERKI VDGNIAYYATPLLNGRGFYDINKDFNRDSDKCAAAVAANMFHYWLDINRDNVDRFLRQNPEKHGI IELPDGQLKLSDFLNTYESDHGYRDKSKLFDFISNNFNGPVWTDKLLDNYINGYAYNYKYGRTIE DPTKNTSKINFFKEVFNEKILTNNHSIRNQNEFSVLLSEALYTGKAIGLSYGPAGLRHSLGHIIS VWGADLDADGNVVAIYVTDSDDKKLTIGDERVGLKRYKISTDDENRLRLTAYEETHNTGGQIRGL WTLDTGKYAWADYFDKTEQTGTDQAEQ (SEQ ID NO: 40) |
| IdeC | RNQITTYSEATPSHITSIWTKGVTPPTNFIEGTDGSHAPYIANQGWYDITKTFNGKDDLLCAAAT AGNMLHWWFDQNKNQIEGYLTEHPEKQAIIFNGEKMFDVKEAISTKDRQLDSKLFEYFKEKAFPT LSARRRGVFPDHVIDMFINGYRLSLDNYDKTPVKEGNKDLRGGIFDQVFTRGDQSKLLINRYNLR TKTINEISQLIKQELIAGKALAISHTYNNIGISHVINLWGADENSEGNLEAIYVTDSDSNASIGM KKYYVGVNSAGEVAVSSKKIDSEHLGAAALGLYTLSAGQGIWHQTN (SEQ ID NO: 41) |
| Ide85 (wt residues 34-341) | MANQEIRYSEVTPYHVISVWTKGVTPPAKFTQGEDVFHAPYVANQGWYDITKTENGKDDLLCGAA TAGNMLHWWFDQNKEKIEAYLKKHPDKQKIMFGDQELLDVRKVINTKGDQTNSELFNYFRDKAFP GLSARRIGVMPDLVLDMFINGYYLNVYKTQTTDVNRTYQEKDRRGGIFDAVFTRGDQSKLLTSRH DFKEKNLKEISDLIKKELTEGKALGLSHTYANVRINHVINLWGADFDSNGNLKAIYVTDSDSNAS IGMKKYFVGVNSAGKVAISAKEIKEDNIGAQVLGLFTLSTGQDSWNQTN (SEQ ID NO: 57) |

In some embodiments, a polypeptide having protease activity comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 4. In some embodiments, the polypeptide having protease activity is IdeS. In some embodiments, the polypeptide having protease activity is IdeSsuis. In some embodiments, the polypeptide having protease activity is IdeE. In some embodiments, the polypeptide having protease activity is IdeZ. In some embodiments, the polypeptide having protease activity is IdeE2. In some embodiments, the polypeptide having protease activity is IdeZ2. In some embodiments, the polypeptide having protease activity is Ide85. In some embodiments, the polypeptide having protease activity is IdeC. In some embodiments, a polypeptide having protease activity comprises an amino acid sequence having at least 50%, 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, or 55.

In some embodiments, a polypeptide having protease activity comprises an amino acid sequence as provided in Table 4. In some embodiments, the polypeptide having protease activity is IdeS. In some embodiments, the polypeptide having protease activity is IdeSsuis. In some embodiments, the polypeptide having protease activity is IdeE. In some embodiments, the polypeptide having protease activity is IdeZ. In some embodiments, the polypeptide having protease activity is IdeE2. In some embodiments, the polypeptide having protease activity is IdeZ2. In some embodiments, the polypeptide having protease activity is Ide85. In some embodiments, the polypeptide having protease activity is IdeC. In some embodiments, a polypeptide having protease activity comprises an amino acid sequence of SEQ ID NO: 26, 28, 29, 31, 36, 37, 38, 39, 40, 41, 50, 51, 52, or 55.

In some embodiments, the protease comprises an amino acid sequence that comprises a signal sequence. In some embodiments, the protease comprises an amino acid sequence that does not comprise a signal sequence. In some embodiments, the signal sequence can have the amino acid sequence of METDTLLLWVLLLWVPGSTG (SEQ ID NO: 53), or MNIQERFSLRKSAVGLVSVSLLCAIYTSTVAA (SEQ ID NO: 54).

In some embodiments the protease has a sequence selected from Table 5.

TABLE 5

| ID | Polypeptide having protease activity Seq |
|---|---|
| PRT-1 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVETRGDQSKLLTSRHDFPKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 56) |
| PRT-2 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVYKTQTTDVNRTYQEKDRRGGIFDAVFTRGDQSKLLTSRHDFPKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQIN (SEQ ID NO: 57) |
| PRT-3 | MRNATEAYAKEVPHQITSVWTKGVTPLTPEQFRYNNEDVIHAPYLAHQGWYDITKAFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTTLLTARHDLKNKGLNDISTIIKQELTEG<br>RALALSHTYANVSISHVINLWGADFNAEGNLEAIYVTDSDANASIGMKKYFVGINAHGHVAISAKKIEGENIG<br>AQVLGLFTLSSGKDIWQKLS (SEQ ID NO: 58) |
| PRT-4 | MANQEIRYSEVTPYHVISVWTKGVTPPANFTQGEDVFHAPYVANQGWYDITKTENGKDDLLCGAATAGNMLHW<br>WFDQNKEQIERYLKEHPEKQKINFNGEQMEDVKEAIDTKDSQLDSKLFYKFKEKAFPYLSTKHLGVFPDHVID<br>MFINGYRLSLTNHGPTPVKEGSKDPRGGIFDAVFTRGDQSKLLTSRHDFPKEKNLKEISDLIKKELTEGKALAL<br>SHTYANVRINHVINLWGADFDSNGNLKAIYVTDSDSNASIGMKKYFVGVNSAGKVAISAKEIKEDNIGAQVLG<br>LFTLSTGQDIWNQTN (SEQ ID NO: 59) |
| PRT-5 | MANQEIRYSEVTPYHVISVWTKGVTPPANFTQGEDVFHAPYVANQGWYDITKTFNGKDDLLCGAATAGNMLHW<br>WFDQNKDQIERYLKKHPEKQKINFNGEQMFDVKEAIDTKNSQLDSKLFEYFKEKAFPYLSTKHLGVFPDHVID<br>MFINGYRLSLINHGPTPVKEGSKDPRGGIFDAVETRGDQSKLLTSRHDFPKEKNLKEISDLIKKELTEGKALGL<br>SHTYANVRINHVINLWGADFDSNGNLEAIYVTDSDSNASIGMKKYFVGVNSAGKVAISAKEIKEDNIGAQVLG<br>LFTLSTGQDIWNQTN (SEQ ID NO: 60) |
| PRT-6 | MANQEIRYSEVTPYHVISVWTKGVTPPANFTQGEDVFHAPYVANQGWYDITKTFNGKDDLLCGAATAGNMLHW<br>WFDQNKEQIERYLKEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVETRGDQSKLLTSRHDFPKEKNLKEISDLIKKELTEGKALGL<br>SHTYANVRINHVINLWGADFDSNGNLKAIYVTDSDSNASIGMKKYFVGVNSAGKVAISAKEIEGDNIGAQVLG<br>LFTLSTGQDIWNQTN (SEQ ID NO: 61) |
| PRT-7 | MANQEIRYSEETPYHVISVWTKGVTPPANFTQGEDVFHAPYVANQGWYDITKTFNGKDDLLCGAATAGNMLHW<br>WFDQNKDQIERYLKKHPEKQKINFNGEQMEDVKEAIDTKDSQTDSKLFEYFKEKAFPYLSTKHLGVFPDHVID<br>MFINGYRLSLTNHGPTPVKEGSKDPRGGIFDAVFTRGDQSKLLTSRHDFPKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWEQTN (SEQ ID NO: 62) |
| PRT-8 | MANQEIRYSEVTPYHVISVWTKGVTPPTNFTQGEDVFHAPYIANQGWYDITKTFNGKDDLLCGAATAGNMLHW<br>WFDQNKDQIERYLKEHPEKQKINFNGEQMFDVKEAIDTKNSQLDSKLFEYFKEKAFPYLSTKHLGVFPDHVLD<br>MFINGYRLSLTNHGPTPVKEGSKDPRGGIFDAVFTRGDQSKLLTSRHDFPKEKNLKEISDLIKQELTEGKALGL<br>SHTYANVRINHVINLWGADFDSNGNLEAIYVTDSDSNASIGMKKYFVGVNSAGKVAISAKEIKDDNIGAQVLG<br>LFTLSTGQDIWNQTN (SEQ ID NO: 63) |
| PRT-9 | MANQEIRYSEETPYHVISVWTKGVTPPANFTQGEDVFHAPYVANQGWYDITKTFNGKDDLLCGAATAGNMLHW<br>WFDQNKEQIERYLKEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVETRGDQSKLLTSRHDFPKEKTLKEISDLIKKELTEGKALAL<br>SHTYANVRINHVINLWGADFDSNGNLKAIYVTDSDSNASIGMKKYFVGVNSAGKVAISAKEIKEDNIGAQVLG<br>LFTLSSGQDIWNQTN (SEQ ID NO: 64) |
| PRT-10 | MANQEIRYSEVTPYTVTSVWTKGVTPPANFTQGEDVFHAPYVANQGWYDITKTFNGKDDLLCGAATAGNMLHW<br>WFDQNKEQIERYLKEHPEKQKINFNGEQMEDVKEAIDTKDSQLDSELFEYFKEKAFPYLSTKHLGVFPDHVID<br>MFINGYRLSLINHGPTPVKEGSKDPRGGIFDAVFTRGDQSKLLTSRHDFPKEKTLKEISDLIKKELTEGKALAL<br>SHTYANVRINHVINLWGADFDSEGNLEAIYVTDSDSNASIGMKKYFVGVNSAGKVAISAKEIEDDNIGAQVLG<br>LFTLSTGQDIWNQTN (SEQ ID NO: 65) |
| PRT-11 | MANQEIRYSEETPYHVISVWTKGVTPPANFTQGEDVFHAPYVANQGWYDITKTFNGKDDLLCGAATAGNMLHW<br>WFDQNKDQIEKYLKEHPEKQKINFNGEQMFDVKEAIDTKDSQTDSKLFEYFKEKAFPYLSTKHLGVFPDHVID<br>MFINGYRLSLTNHGPTPVKEQSKDPRGGIFDAVFTRGDQSKLLTSRHDFPKEKTLKEISDLIKKELSEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWNQTN (SEQ ID NO: 66) |
| PRT-12 | MANQEIRYSEVTPYHVISVWTKGVTPPADFTQGEDVFHAPYKANQGWYDITKTFNGKDDLLCGAATAGNMLHW<br>WFDQNKDQIERYLKEHPEKQKINFNGEQMEDVKEAIDTKDSQTDSKLFEYFKEKAFPYLSTKHLGVFPDHVID<br>MFINGYRLSLTNHGPTPVKRGSKDPRGGFFDAVFTRGDQSKLLTSRHDFPKEKTLNEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWEQTN (SEQ ID NO: 67) |
| PRT-13 | MANQEIRYSEETPYHVISVWTKGVTPPANFTQGEDVFHAPYKANQGWYDITKTFNGKDDLLCGAATAGNMLHW<br>WFDQNKDQIEAYLKEHPEKQKINFNGEQMFDVKEAIDTKDDQTNSKLFEYFKEKAFPYLSTKHLGVFPDHVLD<br>MFINGYRLSLTNHGPTPVKEGSKDPRGGIFDAVFTRGDQSKLLTSRHDFPKEKTLKEISDLIKQELTEGKALAL |

TABLE 5-continued

| ID | Polypeptide having protease activity Seq |
|---|---|
| | SHTYANVRINHVINLWGADFDSNGNLEAIYVTDSDSNASIGMKKYFVGVNSAGKVAISAKEIEDDNIGAQVLG<br>LFTLSTGQDIWNQTN (SEQ ID NO: 68) |
| PRT-14 | MANQEIRYSEVTPYTVTSVWTKGVTPPADFTQGEDVFHAPYIANQGWYDITKTFNGKDDLLCGAATAGNMLHW<br>WFDQNKEQIERYLKKHPEKQKINFNGEQMEDVKEAIDTKDSQTDSELFEYFKEKAFPYLSTKHLGVFPDHVLD<br>MFINGYRLSLTNHGPTPVKEGSKDPRGGIFDAVFTRGDQSKLLTNRHDFKEKTLSEISDLIKKELTEGKALGL<br>SHTYANVRINHVINLWGADFDSEGNLEAIYVTDSDSNASIGMKKYFVGVNSAGKVAISAKEIKEDNIGAQVLG<br>LFTLSTGQDIWNQTN (SEQ ID NO: 69) |
| PRT-15 | MANQEIRYSEVTPYTITSVWTKGVTPPTNFTQGEDVFHAPYVANQGWYDITKTFNGKDDLLCGAATAGNMLHW<br>WFDQNKDEIERYLKEHPEKQKINFNGEQMEDVKEAIDTKDSQTDSKLFEYFKDKAFPYLSTKHLGVFPDHVID<br>MFINGYRLSLTNHGPTPVKRGSKDPRGGIFDAVFTRGDQSKLLTSRHDFKEKNLEISDLIKQELTEGKALGL<br>SHTYANVRINHVINLWGADFNSNGNLKAIYVTDSDSNASIGMKKYFVGVNKAGKVAISAKEIKGDNIGAQVLG<br>LFTLSTGQDIWEQTN (SEQ ID NO: 70) |
| PRT-16 | MANQEIRYSEETPYHITSVWTKGVTPPTDFTQGEDVFHAPYVANQGWYDITKTFNGKDDLLCGAATAGNMLHW<br>WFDQNKDQIERYLKKHPEKQKINFNGEQMEDVKEAIDTKDSQTDSKLFEYFKDKAFPYLSTKHLGVFPDHVLD<br>MFINGYRLNLTNHGPTPVKEGSKDPRGGIFDAVFTRGDQSKLLTSRHDFKEKNLKEISDLIKQELQEGKALGL<br>SHTYANVRINHVINLWGADFDSNGNLKAIYVTDSDSNASIGMKKYYVGVNAAGKVAISAKEIEDDNIGAQVLG<br>LFTLSLGQDIWNQTN (SEQ ID NO: 71) |
| PRT-17 | MANQEIRYSEVTPYHITSVWTKGVTPPTNFTQGEDVFHAPYKANQGWYDITKTFNGKDDLLCGAATAGNMLHW<br>WFDQNKEEIERYLKEHPEKQKINFNGEQMFDVKEAIDTKGSQTDSKLENYFKDKAFPYLSTKHLGVFPDHVLD<br>MFINGYRLSLTNHGPTPVKEQSKDPRGGIFDAVFTRGDQSKLLTSRHDFKEKNLKEISDLIKKELTEGKALGL<br>SHTYANVRINHVINLWGADFDSEGNLEAIYVTDSDSNASIGMKKYFVGVNSAGKVAISAKEIKGDNIGAQVLG<br>LFTLSTGQDIWEKTN (SEQ ID NO: 72) |
| PRT-18 | MANQEIRYSEETPYHVISVWTKGVTPPTNFTQGEDVFHAPYIANQGWYDITKTFNGKDDLLCGAATAGNMLHW<br>WFDQNKEEIEKYLEEHPEKQKINFNGEQMFDVKEVIDTKDSQLDSKLFEYFKEKAFPYLSTKHLGVFPDHVID<br>MFINGYRLNLTNHGPTPVKEGSKDPRGGIFDAVFTRGDQSKLLTERHDFKEKTLKEISQLIKQELTEGKALGL<br>SHTYANVRINHVINLWGADEDSEGNLEAIYVTDSDSNASIGMKKYFVGVNSAGKVAISAKEIEDDNIGAQVLG<br>LFTLSTGQDIWEQTN (SEQ ID NO: 73) |
| PRT-19 | MANQEIRYSEESPSVVTSVWTKGVTPPANFTYGEDVFHAPYIANQGWYDITKTENGKDDLLCGAATAGNMLHW<br>WFDQNKDEIEAYLKKHPEKQKINFNGEQMFDVKEAIDTKDDQTNSKLFNYFKDKAFPYLSTKHLGVFPDHVLD<br>MFINGYRLNLINHGPTPVKEGSKDPRGGIFDAVFTRGDQSKLLTSRHDFKEKTLKEISDLIKQELTEGKALGL<br>SHTYANVRINHVINLWGADENSEGNLKAIYVTDSDSNASIGMKKYFVGVNAAGKVAISAKEIKDDNIGAQVLG<br>LFTLSTGQDIWNQTN (SEQ ID NO: 74) |
| PRT-20 | MANQEIRYSEATPYHITSVWTKGVTPPANFTQGEDVFHAPYVPNQGWYDITKTFNGKDDLLCGAATAGNMLHW<br>WFDQNKDQIERYLKEHPEKQKINFNGEQMFDVKEAIDTKDSQTDSKLENYFKEKAFPYLSTKHLGVFPDHVLD<br>MFINGYRLSLTNHGPTPVKEQSKDPRGGIFDAVFTRGDQSTLLTSRHDFKEKTLKEISDLIKKELQEGKALGI<br>SHTYANVRINHVINLWGADENSEGNLEAIYVTDSDSNASIGMKKYYVGVNSAGKVAISAKEIEDDNIGAQVLG<br>LFTLSTGKDIWEQTN (SEQ ID NO: 75) |
| PRT-21 | MANQEIRYSEVSPSTVTSVWTKGVTPPTNFTYGEDVLHAPYVANQGWYDITKTFNGKDDLLCGAATAGNMLHW<br>WFDQNKEQIENYLKKHPEKQKINFNGEQMFDVKEAIDTKDSQLDSKLFEYFKEKAFPYLSTKHLGVFPDHVID<br>MFINGYRLSLTNHGPTPVKRGSKDPRGGIFDAVFTRGDQSKLLTNRHDFKEKTLKEISDLIKQELTEGKALGI<br>SHTYANVRINHVINLWGADFDAEGNLEAIYVTDSDSNASIGMKKYFVGVNSNGKVAISAKEIEEDNIGAQVLG<br>LFTLSTGQDIWNQTN (SEQ ID NO: 76) |
| PRT-22 | MANQEIRYSEVTPYHVISVWTKGVTPPANFTQGEDVFHAPYVANQGWYDITKTFNGKDDLLCGAATAGNMLHW<br>WFDQNKDQIERYLKEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWNQTN (SEQ ID NO: 77) |
| PRT-23 | MANQEIRYSEVTPYHVISVWTKGVTPPANFTQGEDVFHAPYVANQGWYDITKTFNGKDDLLCGAATAGNMLHW<br>WFDQNKDQIERYLKEHPEKQKINFNGEQMFDVKEAIDTKNSQTDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLEAIYVTDSDSNASIGMKKYFVGVNSAGKVAISAKEIKEDNIGAQVLG<br>LFTLSTGQDIWNQTN (SEQ ID NO: 78) |
| PRT-24 | MANQEIRYSEVTPYHVISVWTKGVTPPANFTQGEDVFHAPYVANQGWYDITKTFNGKDDLLCGAATAGNMLHW<br>WFDQNKDQIERYLKEHPEKQKINFNGEQMEDVKEAIDTKDSQTDSKLFEYFKEKAFPYLSTKHLGVFPDHVLD<br>MFINGYRLSLINHGPTPVKEGSKDPRGGIFDAVETRGDQSKLLTSRHDFKEKTLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWNQTN (SEQ ID NO: 79) |
| PRT-25 | MANQEIRYSEVTPYHVISVWTKGVTPPANFTQGEDVFHAPYVANQGWYDITKTFNGKDDLLCGAATAGNMLHW<br>WFDQNKDQIERYLKEHPEKQKINFNGEQMEDVKEAIDTKDSQTDSKLFEYFKEKAFPYLSTKHLGVFPDHVLD<br>MFINGYRLSLINHGPTPVKEGSKDPRGGIFDAVFTRGDQSKLLTSRHDFKEKNLKEISDLIKQELTEGKALGL<br>SHTYANVRINHVINLWGADFDSNGNLEAIYVTDSDSNASIGMKKYFVGVNSAGKVAISAKEIEDDNIGAQVLG<br>LFTLSTGQDIWNQTN (SEQ ID NO: 80) |
| PRT-26 | MANQEIRYSEVTPYHVISVWTKGVTPPANFTQGEDVFHAPYVANQGWYDITKTFNGKDDLLCGAATAGNMLHW<br>WFDQNKDQIERYLKEHPEKQKINFNGEQMEDVKEAIDTKDSQTDSKLFEYFKEKAFPYLSTKHLGVFPDHVLD<br>MFINGYRLSLTNHGPTPVKEGSKDPRGGIFDAVFTRGDQSKLLTSRHDFKEKTLKEISDLIKQELTEGKALGL |

TABLE 5-continued

| ID | Polypeptide having protease activity Seq |
|---|---|
| | SHTYANVRINHVINLWGADFDSEGNLKAIYVTDSDSNASIGMKKYFVGVNSAGKVAISAKEIKEDNIGAQVLG<br>LFTLSTGQDIWNQTN (SEQ ID NO: 81) |
| PRT-27 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQTDSKLFEYFKEKAFPYLSTKHLGVFPDHVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLEAIYVTDSDSNASIGMKKYFVGVNSAGKVAISAKEIKEDNIGAQVLG<br>LFTLSTGQDSWNQTN (SEQ ID NO: 82) |
| PRT-28 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKDHQLDSKLFEYFKEKAFPYLSTKHLGVFPDHVLD<br>MFINGYRLSLTNHGPTPVKEGSKDPRGGIFDAVETRGDQSKLLTSRHDFKEKTLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 83) |
| PRT-29 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKQELTEGKALGL<br>SHTYANVRINHVINLWGADFDSNGNLEAIYVTDSDSNASIGMKKYFVGVNSAGKVAISAKEIEEDNIGAQVLG<br>LFTLSTGQDSWNQTN (SEQ ID NO: 84) |
| PRT-30 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVLD<br>MFINGYRLSLTNHGPTPVKEGSKDPRGGIFDAVETRGDQSKLLTSRHDFKEKTLKEISDLIKKELTEGKALGL<br>SHTYANVRINHVINLWGADFDSEGNLKAIYVTDSDSNASIGMKKYFVGVNSAGKVAISAKEIKEDNIGAQVLG<br>LFTLSTGQDSWNQTN (SEQ ID NO: 85) |
| PRT-31 | MANQEIRYSEVTPYHVISVWTKGVTPPANFTQGEDVFHAPYVANQGWYDITKTFNGKDDLLCGAATAGNMLHW<br>WFDQNKDQIERYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 86) |
| PRT-32 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDIWNQTN (SEQ ID NO: 87) |
| PRT-33 | MANQEIRYSEVTPYHVISVWTKGVTPPANFTQGEDVFHAPYVANQGWYDITKTFNGKDDLLCGAATAGNMLHW<br>WFDQNKDQIKRYLKEHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 88) |
| PRT-34 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 89) |
| PRT-35 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKDHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 90) |
| PRT-36 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQTDSKLFEYFKEKAFPYLSTKHLGVFPDHVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQIN (SEQ ID NO: 91) |
| PRT-37 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKTLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 92) |
| PRT-38 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLEAIYVTDSDSNASIGMKKYFVGVNSAGKVAISAKEIKEDNIGAQVLG<br>LFTLSTGQDSWNQTN (SEQ ID NO: 93) |
| PRT-39 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKQELTEGKALGL |

TABLE 5-continued

| ID | Polypeptide having protease activity Seq |
|---|---|
| | SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 94) |
| PRT-40 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVLD<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 95) |
| PRT-41 | MANQEIRYSEVTPYHVISVWTKGVTPPANFTQGEDVFHAPYVANQGWYDITKTFNGKDDLLCGAATAGNMLHW<br>WFDQNKDYIDRYLEEHPEKQKINFNGEQMEDVKEAIDTKNSQLDSKLFEYFKEKAFPYLSTKHLGVFPPDLVLD<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 96) |
| PRT-42 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKQKINFNGEQMFDVKEAIDTKNDQLDSKLFEYFKEKAFPYLSTKHLGVFPDLVID<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 97) |
| PRT-43 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKQKINFNGEQMFDVKEAIDTKNDQTDSKLFEYFKEKAFPYLSTKHLGVFPDLVID<br>MFINGYRLSLINHGPTPVKEGSKDPRGGIFDAVFTRGDQSKLLTSRHDLKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQIN (SEQ ID NO: 98) |
| PRT-44 | MANQEIRYSEVTPYHVISVWTKGVTPPANFTQGEDVFHAPYVANQGWYDITKTENGGDDLLCGAATAGNMLHW<br>WFDQNKDQIDRYLEEHPEKQKINFNGEQMEDVKEAIDTKNSQTDSKLFEYFKEKAFPYLSTKHLGVFPDLVLD<br>MFINGYRLSLINHGPTPVKEGSKDPRGGFFDDVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 99) |
| PRT-45 | MANQEIRYSEVTPYHVISVWTKGVTPPANFTQGEDVFHAPYVANQGWYDITKTENGGDDLLCGAATAGNMLHW<br>WFDQNKEQIDRYLEEHPEKQKINFNGEQMEDVKEAIDTKNSQTDSKLFEYFKEKAFPYLSTKHLGVFPDLVLD<br>MFINGYRLSLTNHGPTPVKEGSKDPRGGIFDAVETRGDQSKLLTSRHDFKEKNLEEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 100) |
| PRT-46 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKAKINFNGEQMFDVKEAIDTKNDQLDSKLFEYFKEKAFPYLSTKHLGVFPDLVLD<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASIGMKRYFVGVNSAGKVAISAKEIKEDNIGAQVLG<br>LFTLSTGQDSWNQTN (SEQ ID NO: 101) |
| PRT-47 | MANQEIRYSEVTPYHVISVWTKGVTPPANFTQGEDVFHAPYVANQGWYDINKTFNGGDDLLCGAATAGNMLHW<br>WFDQNKDQIDRYLKEHPEKAKINFNGEQMEDVKEAIDTKNDQTNSKLFEYFKEKAFPYLSTKHLGVFPDLVLD<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASVGMKKYFVGVNSAGKVAISAKEIKEDNIGAQVLG<br>LFTLSTGQDSWNQTN (SEQ ID NO: 102) |
| PRT-48 | MANQEIRYSEVTPYHVISVWTKGVTPPANFTQGEDVFHAPYKANQGWYDINKTENGGDDLLCGAATAGNMLHW<br>WFDQNKDYIDRYLEEHPEKQKINFNGEQMFDVKEAIDTKNNQTDSKLFEYFKEKAFPYLSTKHLGVFPDRVID<br>MFINGYRLSLTNHGPTPVKEGSKDPRGGFFDDVFTRGDQSKLLTSRHDFKEKNLKEISDLIKKELKEGKALGL<br>SHTYANVRINHVINLWGADFDSNGNLKAIYVTDSDSNASVGMKKYRVGVNSAGKVAISAKEIKEDNIGAQVLG<br>LFTLSTGQDSWNQTN (SEQ ID NO: 103) |
| PRT-49 | MANQEIRYSEVTPYHVISVWTKGVTPPANFTQGEDVFHAPYVANQGWYDITKTFNGKDDLLCGAATAGNMLHW<br>WFDQNKDYIDRYLEEHPEKAKINFNGEQMFDVKEAIDTKNDQTDSKLFEYFKEKAFPYLSTKHLGVFPDHVID<br>MFINGYRLSLTNHGPTPVKEGSKDPRGGFFDDVFGRGDQSKLLTSRHDFKEKNLKEISDLIKKELTEGKALGL<br>SHTYANVRINHVINLWGADFDSNGNLKAIYVTDSDSNASVGMKKYFVGVNSAGKVAISAKEIKEDNIGAQVLG<br>LFTLSTGQDSWNQTN (SEQ ID NO: 104) |
| PRT-50 | MANQEIRYSEVTPYHVISVWTKGVTPPANFTQGEDVFHAPYVANQGWYDINKTFNGKDDLLCGAATAGNMLHW<br>WFDQNKEQIERYLKEHPEKGSKINFNGEQMFDVKEAIDTKNNQTDSKLFEYFKEKAFPYLSTKHLGVFPDRVLD<br>MFINGYRLSLINHGPTPVKEGSKDPRGGFFDDVFGRGDQSKLLTSRHDFKEKNLEEISDLIKKELTEGKALGL<br>SHTYANVRINHVINLWGADFDSNGNLKAIYVTDSDSNASVGMKKYFVGVNSAGKVAISAKEIKEDNIGAQVLG<br>LFTLSTGQDSWNQTN (SEQ ID NO: 105) |
| PRT-51 | MANQEIRYSEVTPYHVISVWTKGVTPPANFTQGEDVFHAPYVANQGWYDINKTFNGKDDLLCGAATAGNMLHW<br>WFDQNKDYIDRYLKKHPEKAKINFNGEQMFDVKEAIDTKNDQLDSKLFEYFKEKAFPYLSTKHLGVFPDLVLD<br>MFINGYRLSLTNHGPTPVKEGSKDPRGGFFDDVFTRGDQSKLLTSRHDFKEKNLEEISDLIKKELTEGKALGL<br>SHTYANVRINHVINLWGADFDENGNLKAIYVTDSDSNASIGMKRYFVGVNSAGKVAISAKEIKEDNIGAQVLG<br>LFTLSTGQDSWNQTN (SEQ ID NO: 106) |
| PRT-52 | MANQEIRYSEVTPYHVISVWTKGVTPPANFTQGEDVFHAPYVANQGWYDINKTFNGGDDLLCGAATAGNMLHW<br>WFDQNKEYIDRYLKEHPEKQKINFNGEQMEDVKEAIDTKNSQTDSKLFEYFKEKAFPYLSTKHLGVFPDLVID<br>MFINGYRLSLTNHGPTPVKEGSKDPRGGFFDAVFTRGDQSKLLTSRHDFKEKNYNEISDLIKKELKEGKALGL |

TABLE 5-continued

| ID | Polypeptide having protease activity Seq |
|---|---|
| | SHTYANVRINHVINLWGADFDSNGNLKAIYVTDSDSNASVGMKKYFVGVNSAGKVAISAKEIKEDNIGAQVLG<br>LFTLSTGQDSWNQIN (SEQ ID NO: 107) |
| PRT-53 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKQKINFNGEQMEDVKEAIDTKNDQLDSKLFEYFKEKAFPYLSTKHLGVFPDLVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 108) |
| PRT-54 | MANQEIRYSEVTPYHVTSVWTKGVTPPANFTQGEDVFHAPYVANQGWYDITKTFNGKDDLLCGAATAGNMLHW<br>WFDQNKDQIDRYLEEHPEKQKINFNGEQMEDVKEAIDTKNHQLDSKLFEYFKEKAFPYLSTKHLGVFPDLVID<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 109) |
| PRT-55 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKAKINFNGEQMEDVKEAIDTKNHQLDSKLFEYFKEKAFPYLSTKHLGVFPDLVID<br>MFINGYRLSLTNHGPTPVKEGSKDPRGGFFDAVFGRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 110) |
| PRT-56 | MANQEIRYSEVTPYHVISVWTKGVTPPANFTQGEDVFHAPYVANQGWYDINKTENGKDDLLCGAATAGNMLHW<br>WFDQNKDQIDRYLEEHPEKQKINFNGEQMEDVKEAIDTKNHQLDSKLFEYFKEKAFPYLSTKHLGVFPDLVLD<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASVGMKKYFVGVNSAGKVAISAKEIKEDNIGAQVLG<br>LFTLSTGQDSWNQTN (SEQ ID NO: 111) |
| PRT-57 | MANQEIRYSEVTPYHVISVWTKGVTPPANFTQGEDVFHAPYVANQGWYDINKTFNGKDDLLCGAATAGNMLHW<br>WFDQNKDYIDRYLEEHPEKQKINFNGEQMEDVKEAIDTKNHQLDSKLFEYFKEKAFPYLSTKHLGVFPDLVID<br>MFINGYRLSLTNHGPTPVKEGSKDPRGGFFDAVFGRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 112) |
| PRT-58 | MANQEIRYSEVTPYHVISVWTKGVTPPANFTQGEDVFHAPYVANQGWYDINKTFNGKDDLLCGAATAGNMLHW<br>WFDQNKEYIDRYLKEHPEKQKINFNGEQMFDVKEAIDTKNHQLDSKLFEYFKEKAFPYLSTKHLGVFPDLVLD<br>MFINGYRLSLTNHGPTPVKEGSKDPRGGFFDDVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 113) |
| PRT-59 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGFFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 114) |
| PRT-60 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKAKINFNGEQMFDVKEAIDTKNHQLDSKLFEYFKEKAFPYLSTKHLGVFPDHVID<br>MFINGYRLSLTNHGPTPVKEGSKDPRGGIFDAVFGRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 115) |
| PRT-61 | MANQEIRYSEVTPYHVISVWTKGVTPPANFTQGEDVFHAPYVANQGWYDINKTFNGKDDLLCGAATAGNMLHW<br>WFDQNKEYIKRYLEEHPEKQKINFNGEQMEDVKEAIDTKNHQLDSKLFEYFKEKAFPYLSTKHLGVFPDHVLD<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASVGMKKYFVGVNSAGKVAISAKEIKEDNIGAQVLG<br>LFTLSTGQDSWNQTN (SEQ ID NO: 116) |
| PRT-62 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVFGRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 117) |
| PRT-63 | MANQEIRYSEVTPYHVISVWTKGVTPPANFTQGEDVFHAPYVANQGWYDITKTFNGKDDLLCGAATAGNMLHW<br>WFDQNKEQIKRYLKEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDDVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 118) |
| PRT-64 | MANQEIRYSEVTPYHVISVWTKGVTPPANFTQGEDVFHAPYVANQGWYDITKTFNGKDDLLCGAATAGNMLHW<br>WFDQNKDQIDRYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 119) |
| PRT-65 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDLVID<br>MFINGYRLSLTNHGPTPVKEGSKDPRGGIFDAVFTRGDQSKLLTSRHDFKEKNLKEISDLIKKELTEGKALGL |

TABLE 5-continued

| ID | Polypeptide having protease activity Seq |
|---|---|
| | SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 120) |
| PRT-66 | MANQEIRYSEVTPYHVISVWTKGVTPPANFTQGEDVFHAPYVANQGWYDITKTFNGKDDLLCGAATAGNMLHW<br>WFDQNKDYIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 121) |
| PRT-67 | MANQEIRYSEVTPYHVISVWTKGVTPPANFTQGEDVFHAPYVANQGWYDINKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 122) |
| PRT-68 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDDVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQIN (SEQ ID NO: 123) |
| PRT-69 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNDQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 124) |
| PRT-70 | MANQEIRYSEVTPYHVISVWTKGVTPPANFTQGEDVFHAPYVANQGWYDITKTFNGKDDLLCGAATAGNMLHW<br>WFDQNKEQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 125) |
| PRT-71 | MANQEIRYSEVTPYHVISVWTKGVTPPANFTQGEDVFHAPYVANQGWYDITKTFNGKDDLLCGAATAGNMLHW<br>WFDQNKEEIEAYLKKHPEKQKIMFGDQELLDVRKVINTKGSQTNSELFNYFRDKAFPGLSARRLGVMPDLVLD<br>MFINGYYLNVYKTQTTDVNRTYQEKDKRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 126) |
| PRT-72 | MANQEIRYSEVTPYHVTSVWTKGVTPPAKFTQGEDVFHAPYVANQGWYDITKTFNGKDDLLCGAATAGNMLHW<br>WFDQNKEYIEAYLKKHPEKQKIMFGDQELLDVRKVINTKGDQTNSELFNYFRDKAFPYLSARRLGVMPDLVLD<br>MFINGYYLNVTKTQTTDVNRTYQEKDRRGGIFDAVETRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 127) |
| PRT-73 | MANQEIRYSEVTPYHVISVWTKGVTPPANFTQGEDVFHAPYVANQGWYDITKTFNGKDDLLCGAATAGNMLHW<br>WFDQNKEKIEAYLKKHPEKQKIMFGDQELLDVRKVINTKDDQTNSELFNYFRDKAFPGLSARRLGVMPDLVLD<br>MFINGYYLNVTKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 128) |
| PRT-74 | MANQEIRYSEVTPSHVISVWTKGVTPPANFTQGEDVFHAPYVANQGWYDITKTFNGKDNLLCGAATAGNMLHW<br>WFDQNKEEIEAYLKKHPEKQKIMFGDQELLDVRKVINTKDSQTNSELFNYERDKAFPGLSARRLGVMPDLVLD<br>MFINGYYLNVYKTQTTDVNRTYQEKDRRGGIFDAVETRGDQSKLLTSRHDFKEKTLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 129) |
| PRT-75 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKDDQTNSELFNYFRDKAFPGLSARRLGVMPDLVLD<br>MFINGYRLNVTKTQTTDVNETYQTKDKRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKDDNIGAQV<br>LGLFTLSTGQDIWNQTN (SEQ ID NO: 130) |
| PRT-76 | MANQEIRYSEVTPYHITSVWTKGVTPPAKFTQGEDVFHAPYVANQGWYDITKTFNGKDDLLCGAATAGNMLHW<br>WFDQNKEEIEAYLKKHPEKQKIMFGDQELLDVRKVINTKDQTNSALFNYFNDKAFPNLSARRLGVMPDLVLD<br>MFINGYYLNVYKTQTTDVNRTYQTKDRRGGIFDAVFTRGDQSKLLTERHDFKEKTLKEISDLIKQELTEGKAL<br>GLSHTYANVRINHVINLWGADFDSNGNLEAIYVTDSDSNASIGMKKYFVGVNSAGKVAISAKEIKEDNIGAQV<br>LGLFTLSTGQDIWNQTN (SEQ ID NO: 131) |
| PRT-77 | MANQEIRYSEVTPYHVISVWTKGVTPPTNFTQGEDVFHAPYVANQGWYDITKTFNGKDNLLCGAATAGNMLHW<br>WFDQNKEEIERYLKKHPEKQKIMFGDQELLDVRKVINTKDDQKNSELFNYFRDKAFPGLSARRLGVMPDLVLD<br>MFINGYYLNVGKTQTTDVNRTYQEKDKRGGIFDAVFTRGDQSKLLTSRHDFKEKNLKEISDLIKQELTEGKAL<br>GLSHTYANVRINHVINLWGADFDSNGNLEAIYVTDSDSNASIGMKKYFVGVNSAGKVAISAKEIEEDNIGAQV<br>LGLFTLSTGQDIWNQTN (SEQ ID NO: 132) |
| PRT-78 | MANQEIRYSEETPYHVTSVWTKGVTPPADFTQGEDVFHAPYVANQGWYDITKTFNGKDDLLCGAATAGNMLHW<br>WFDQNKEYIEAYLKKHPEKQKIMFGDQELLDVRKAINTKGSQKNSELFNYFRDKAFPNLSARRLGVMPDLVLD<br>MFINGYYLNVTKTQTTDVNRTYQEKDKRGGIFDAVFTRGDQSKLLTSRHDFKEKGLKEISDLIKQELTEGKAL |

TABLE 5-continued

| ID | Polypeptide having protease activity Seq |
|---|---|
| | GLSHTYANVRINHVINLWGADFDSDGNLKAIYVTDSDSNASIGMKKYFVGVNSAGKVAISAKEIKEDNIGAQV<br>LGLFTLSTGQDIWNQTN (SEQ ID NO: 133) |
| PRT-79 | MANQEIRYSEVTPKTITSVWTKGVTPPAKFTQNEDVFHAPYVANQGWYDITKTFNGKDDLLCGAATAGNMLHW<br>WFDQNKEQIEAYLKKHPEKQKIMFGDQELLDVRKVINTKDDQTNSELFNYFKDKAFPNLSARRLGVMPDLVLD<br>MFINGYRLNVGKTQTTDVNRTYQDKDPRGGIFDAVFTRGDQSKLLTSRHDFKEENLKEISDLIKQELTEGKAL<br>GLSHTYANVRINHVINLWGADEDSEGNLEAIYVTDSDSNASIGMKKYFVGVNSAGKVAISAKEIEEDNIGAQV<br>LGLFTLSTGQDIWEQTN (SEQ ID NO: 134) |
| PRT-80 | MANQEIRYSEVTPKHITSVWTKGVTPPTQFIQGEDVFHAPYKANQGWYDITKTFNGKDDLLCGAATAGNMLHW<br>WFDQNKEEIEAYLKKHPEKQKIMFGDQELLDVRKAINTKDDQTNSELFNYERDKAFPNLSARRLGVMPDHVLD<br>MFINGYYLNVNKTQTTDVNRTYQEKDPRGGIFDAVFTRGDQSKLLTSRHDFKEKTLKEISDLIKQELTEGKAL<br>GLSHTYANVRINHVINLWGADFDSNGNLKAIYVTDSDSDASIGMKKYFVGVNSAGKVAISAKEIKGDNIGAQV<br>LGLFTLSTGQDIWNQTN (SEQ ID NO: 135) |
| PRT-81 | MANQEIRYSEVTPSHVTSVWTKGVTPPADFTQGEDVFHAPYVANQGWYDITKTFNGKDNLLCGAATAGNMLHW<br>WFDQNKEQIENYLKKHPEKQKIMFGDQELLDVRKVINTKDSQTNSALFNYFRDKAFPNLSARRLGVMPDLVLD<br>MFINGYYLNLTKTQTTDVNRTYQTKDKRGGIFDAVFTRGDQSKLLTSRHDFKEKTLKEISDLIKQELTEGKAL<br>GLSHTYANVRINHVINLWGADFDSNGNLKAIYVTDSDSNASIGMKKYFVGVNSAGKVAISAKEITEDNIGAQV<br>LGLFTLSTGKDQWNQTN (SEQ ID NO: 136) |
| PRT-82 | MANQEIRYSEVTPSTITSVWTKGVTPPAQFIQNEDVFHAPYVANQGWYDITKTFNGKDDLLCGAATAGNMLHW<br>WFDQNKEEIEAYLKKHPEKQKIMFGDQELLDVRKVINTKDDQTNSELFNYFKDKAFPNLSARRLGVMPDLVLD<br>MFINGYYLNVGKTQTTDVNRTYQNKDRRGGIFDAVETRGDQSKLLTARHDFKEKNLNEISDLIKQELTEGKAL<br>ALSHTYANVSINHVINLWGADFDANGNLEAIYVTDSDSNASIGMKKYFVGVNSAGKVAISAKEIEEDNIGAQV<br>LGLFTLSTGQDIWNKIN (SEQ ID NO: 137) |
| PRT-83 | MANQEIRYSEETPYHVISVWTKGVTPPEKFTQGEDVFHAPYVANQGWYDITKTFNGKDDLLCGAATAGNMLHW<br>WFDQNKDQIEAYLSKHPEKQKIMFGDQELLDVRKAINTKDSQTNSELFNYERDKAFPNLSARRLGVMPDLVLD<br>MFINGYRLNVTKTQTTDVNETYQEKDKRGGIFDAVFTRGDQSKLLTSRHDFKEKTLNEISDLIKKELTEGKAL<br>GISHTYANVRINHVINLWGADENSEGNLEAIYVTDSDSNASIGMKKYFVGVNSAGKVAISAKEIEEENIGAQV<br>LGLFTLSTGQDIWQQTN (SEQ ID NO: 138) |
| PRT-84 | MANQEIRYSEETPYTVTSVWTKGVTPPTQFIQGEDVFHAPYKANQGWYDITKTFNGKDNLLCGAATAGNMLHW<br>WFDQNKEYIEAYLKKHPEKQKIMFGDQELLDVRKVINTKDSQTDSKLENYFKDKAFPNLSARRLGVMPDLVLD<br>MFINGYYLNVGKTQTTDVNRTYQEKDKRGGIFDAVFTRGDQSKLLTSRHDFKEKSLKEISDLIKKELTEGKAL<br>GLSHTYANVRINHVINLWGADFDSEGNLKAIYVTDSDSDASIGMKKYFVGVNSSGKVAISAKEIEEDNIGAQV<br>LGLFTLSSGQDIWNQIN (SEQ ID NO: 139) |
| PRT-85 | MANQEIRYSEVTPKTITSVWTKGVTPPADFTQGEDVFHAPYKPNQGWYDINKTFNGKDNLLCGAATAGNMLHW<br>WFDQNKEQIEAYLKKHPEKQKIMFGDQELLDVRKAINTKDDQTDSKLFNYFKDKAFPNLSARRLGVMPDHVLD<br>MFINGYRLNVTKTQTTDVNRTYQTKDKRGGFFDAVFTRGDQSKLLTNRHDFKEKNLKEISDLIKKELTEGKAL<br>GLSHTYANVRINHVINLWGADFDSEGNLKAIYVTDSDSNASIGMKKYYVGVNSAGKVAISAKEIKGENIGAQV<br>LGLYTLSTGQDIWNQTN (SEQ ID NO: 140) |
| PRT-86 | MANQEIRYSEEDPKHVTSVWTKGVTPPTDFTQGEDVLHAPYIANQGWYDITKTFNGKDDLLCGAATAGNMLHW<br>WFDQNKEEIENYLKKHPEKQKIMFGDQELLDVRKVINTKDSQTNSKLFNYFREKAFPNLSARRLGVMPDLVLD<br>MFINGYYLNVTKTQTTDVNRTYQTKDKRGGIFDAVFTRGDQTKLLTNRHDFKEKTLNEISDLIKQELQEGKAL<br>GLSHTYANVRINHVINLWGADFDSNGNLEAIYVTDSDANASIGMKKYFVGKNSAGKVAISAKEIKDDNIGAQV<br>LGLFTLSTGQDIWNQTN (SEQ ID NO: 141) |
| PRT-87 | MANQEIRYSEVTPYHITSVWTKGVTPPEQFTQGEDVFHAPYIANQGWYDITKTFNGKDNLLCGAATAGNMLHW<br>WFDQNKEEIERYLKKYPEKQKIMFGDQELLDVRKVINTKDSQTNSKLFEYFRDKAFPNLSARRLGVMPDLVLD<br>MFINGYYLSVTKTQTTDVNRTYGNKDNRGGIFDAVFTRGDQSKLLTNRHDFKEKNLKEISDLIKQELQEGKAL<br>ALSHTYANVRINHVINLWGADFDSEGNLKAIYVTDSDSNASIGMKKYFVGVNSSGKVAISAKEIEEDNIGAQV<br>LGLFTLSTGQDIWEQTN (SEQ ID NO: 142) |
| PRT-88 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKGDQTNSELFNYERDKAFPGLSARRLGVMPDLVLD<br>MFINGYYLNVYKTQTTDVNRTYQEKDRRGGIFDAVETRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQIN (SEQ ID NO: 143) |
| PRT-89 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKDDQTNSELFNYFRDKAFPGLSARRLGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 144) |
| PRT-90 | MANQEIRYSEETPYHVISVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKDDQTNSELFNYFRDKAFPGLSARRLGVMPDLVLD<br>MFINGYYLNVYKTQTTDVNRTYQEKDRRGGIFDAVFTRGDQSKLLTSRHDFKEKTLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 145) |
| PRT-91 | MANQEIRYSEETPYHITSVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKDDQTNSELFNYFRDKAFPNLSARRLGVMPDLVLD<br>MFINGYYLNVGKTQTTDVNRTYQEKDKRGGIFDAVFTRGDQSKLLTSRHDFKEKNLKEISDLIKQELTEGKAL |

TABLE 5-continued

| ID | Polypeptide having protease activity Seq |
|---|---|
| | GLSHTYANVRINHVINLWGADFDSNGNLKAIYVTDSDSNASIGMKKYFVGVNSAGKVAISAKEIEEDNIGAQV<br>LGLFTLSTGQDIWNQTN (SEQ ID NO: 146) |
| PRT-92 | MANQEIRYSEVTPYTITSVWTKGVTPPADFTQGEDVFHAPYVANQGWYDITKTFNGKDDLLCGAATAGNMLHW<br>WFDQNKEKIEAYLKKHPEKQKIMFGDQELLDVRKAINTKDDQTNSELFNYFRDKAFPNLSARRLGVMPDLVLD<br>MFINGYYLNVYKTQTTDVNRTYQEKDKRGGIFDAVFTRGDQSKLLTSRHDFKEENLKEISDLIKQELTEGKAL<br>GLSHTYANVRINHVINLWGADFDSEGNLKAIYVTDSDSNASIGMKKYFVGVNSAGKVAISAKEIKEDNIGAQV<br>LGLFTLSTGQDIWNQTN (SEQ ID NO: 147) |
| PRT-93 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKDDQTNSELFNYFRDKAFPGLSARRIGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 148) |
| PRT-94 | MANQEIRYSEETPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVYKTQTTDVNRTYQEKDRRGGIFDAVETRGDQSKLLTSRHDFKEKTLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 149) |
| PRT-95 | MANQEIRYSEVTPYHITSVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVGKTQTTDVNRTYQEKDKRGGIFDAVFTRGDQSKLLTSRHDFKEKNLKEISDLIKQELTEGKAL<br>GLSHTYANVRINHVINLWGADFDSNGNLKAIYVTDSDSNASIGMKKYFVGVNSAGKVAISAKEIEEDNIGAQV<br>LGLFTLSTGQDSWNQTN (SEQ ID NO: 150) |
| PRT-96 | MANQEIRYSEVTPYTVTSVWTKGVTPPADFTQGEDVFHAPYVANQGWYDITKTFNGKDDLLCGAATAGNMLHW<br>WFDQNKEKIEAYLKKHPDKQKIMFGDQELLDVRKAINTKGDQTNSELFNYFRDKAFPGLSARRIGVMPDLVLD<br>MFINGYYLNVYKTQTTDVNRTYQEKDRRGGIFDAVETRGDQSKLLTSRHDFKEKNLKEISDLIKKELTEGKAL<br>GLSHTYANVRINHVINLWGADFDSEGNLKAIYVTDSDSNASIGMKKYFVGVNSAGKVAISAKEIKEDNIGAQV<br>LGLFTLSTGQDSWNQTN (SEQ ID NO: 151) |
| PRT-97 | MANQEIRYSEVTPYHVTSVWTKGVTPPAKFTQGEDVFHAPYVANQGWYDITKTFNGKDDLLCGAATAGNMLHW<br>WFDQNKEKIEAYLKKHPEKQKIMFGDQELLDVRKVINTKGDQTNSELFNYFRDKAFPGLSARRIGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 152) |
| PRT-98 | MANQEIRYSEVTPYHVTSVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRLGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 153) |
| PRT-99 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDIWNQTN (SEQ ID NO: 154) |
| PRT-100 | MANQEIRYSEVTPYHVTSVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPNLSARRIGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 155) |
| PRT-101 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVYKTQTTDVNRTYQEKDKRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 156) |
| PRT-102 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVYKTQTTDVNRTYQEKDRRGGIFDAVETRGDQSKLLTSRHDFKEKNLKEISDLIKQELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 157) |
| PRT-103 | MANQEIRYSEVTPYHVTSVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGSQTNSELFNYFRDKAFPGLSARRIGVMPDLVLD<br>MFINGYYLNVYKTQTTDVNRTYQEKDRRGGIFDAVETRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 158) |
| PRT-104 | MANQEIRYSEVTPYHVISVWTKGVTPPAKFTQGEDVFHAPYVANQGWYDITKTFNGKDDLLCGAATAGNMLHW<br>WFDQNKEKIEAYLKKHPDKQKIMFGDQELLDVRKVINTKGDQTNSELFNYFRDKAFPGLSARRIGVMPDLVLD<br>MFINGYYLNVTKTQTTDVNRTYQEKDRRGGIFDAVETRGDQSKLLTSRHDFKEKNLKEISDLIKKELTEGKAL |

TABLE 5-continued

| ID | Polypeptide having protease activity Seq |
|---|---|
| | GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 159) |
| PRT-105 | MANQEIRYSEVTPYHVTSVWTKGVTPPAKFTQGEDVFHAPYVANQGWYDITKTFNGKDDLLCGAATAGNMLHW<br>WFDQNKEEIEAYLKKHPDKQKIMFGDQELLDVRKVINTKGDQTNSELFNYERDKAFPGLSARRIGVMPDLVLD<br>MFINGYYLNVYKTQTTDVNRTYQEKDRRGGIFDAVFTRGDQSKLLTSRHDFKEKNLKEISDLIKKELTEGKAL<br>GLSHTYANVRINHVINLWGADFDSNGNLKAIYVTDSDSNASIGMKKYFVGVNSAGKVAISAKEIKEDNIGAQV<br>LGLFTLSTGQDSWNQTN (SEQ ID NO: 160) |
| PRT-106 | MRNATEAYAKEVPHQITSVWTKGVTPLTPEQFRYNNEDVIHAPYLAHQGWYDITKTFNGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTTLLTARHDLKNKGLNDISTLIKQELTEG<br>RALALSHTYANVSISHVINLWGADFNAEGNLEAIYVTDSDANASIGMKKYFVGINASGKVAISAKKIEGENIG<br>AQVLGLFTLSSGKDIWQKLS (SEQ ID NO: 161) |
| PRT-107 | MRNATEAYAKEVPHQITSVWTKGVTPLTPEQFRYNNEDVIHAPYLANQGWYDITKAFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQTKDKRGGIFDAVETRGDQTTLLTARHDLKNKGLNDISTIIKQELTEG<br>KALALSHTYANVSISHVINLWGADFNAEGNLEAIYVTDSDANASIGMKKYFVGVNAAGHVAISAKKIEGENIG<br>AQVLGLFTLSSGKDIWQKLS (SEQ ID NO: 162) |
| PRT-108 | MRNATEAYAKEVPHQITSVWTKGVTPPTPEQFRYNNEDVIHAPYTAHQGWYDITKTFDGKDNLLCGAATAGNM<br>LHWWFDQNKTEIEAYLSKHPEKQKIIFNNQELFDLKAAIDTKDSQTNSQLFNYERDKAFPNLSARQLGVMPDL<br>VLDMFINGYYLNVFKTQSTDVNRPYQDKDKRGGIFDAVETRGDQTTLLTARHDLKNKGLNDISTLIKQELTEG<br>RALALSHTYANVSISHVINLWGADENAEGNLEAIYVIDSDANASIGMKKYFVGINAAGHVAISAKKIEGENIG<br>AQVLGLFTLSSGKDIWQKLS (SEQ ID NO: 163) |
| PRT-109 | MRNATEAYAKEVPHTITSVWTKGVTPLTPEQFRYNNEDVIHAPYVAHQGWYDITKTFDGKDNLLCGAATAGNM<br>LHWWFDQNKTEIEAYLSKHPEKQKIIFNNQELFDLKAAIDTKDSQTNSQLFNYERDKAFPNLSARQLGVMPDL<br>VLDMFINGYYLNVFKTQSTDVNRPYQDKDKRGGIFDAVFTRGDQTTLLTARHDLKNKGLNEISTLIKQELTEG<br>KALALSHTYANVSISHVINLWGADFNAEGNLEAIYVTDSDDNASIGMKKYFVGVNAAGKVAISAKKIEGENIG<br>AQVLGLFTLSSGKDIWQKLS (SEQ ID NO: 164) |
| PRT-110 | MRNATEAYAKEVPHQITSVWTKGVTPPTPEQFRYNNEDVFHAPYTAHQGWYDITKTFDGKDNLLCGAATAGNM<br>LHWWFDQNKTEIEAYLSKHPEKQKIIFNNQELFDLKAAIDTKDSQTNSALFNYERDKAFPNLSARQLGVMPDL<br>VLDMFINGYYLNVFKTQSTDVNRPYQDKDKRGGIFDAVFTRGDQTTLLTARHDLKNKTLNDISTIIKQELTEG<br>RALALSHTYANVSISHVINLWGADFNAEGNLEAIYVTDSDSNASIGMKKYFVGVNSAGKVAISAKKIEGENIG<br>AQVLGLFTLSSGKDIWQKLS (SEQ ID NO: 165) |
| PRT-111 | MRNATEAYAKEVPHQITSVWTKGVTPPTPEQFRYNNEDVFHAPYLAHQGWYDITKTFNGKDNLLCGAATAGNM<br>LHWWFDQNKTEIEAYLKKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTTLLTNRHDLKNKGLNDISTLIKQELTEG<br>KALALSHTYANVSISHVINLWGADFNAEGNLEAIYVTDSDANASIGMKKYFVGINSAGHVAISAKKIEGENIG<br>AQVLGLFTLSSGKDIWQKLS (SEQ ID NO: 166) |
| PRT-112 | MRNATEAYAKEVPHKITSVWTKGVTPLTPEQFRYNGEDVIHAPYLANQGWYDITKTFDGKDNLLCGAATAGNM<br>LHWWFDQNKTEIEAYLKKHPEKQKIIFNNQELFDLKAAIDTKDSQTNSALFNYFKDKAFPNLSARQLGVMPDH<br>VLDMFINGYYLNVFKTQSTDVNRPYQDKDKRGGIFDAVFTRGDQTKLLTARHDLKNKGLNEISTLIKQELTEG<br>KALALSHTYANVSISHVINLWGADENAEGNLEAIYVTDSDANASIGMKKYFVGVNSASGKVAISAKKIEGENIG<br>AQVLGLFTLSSGKDIWQKLS (SEQ ID NO: 167) |
| PRT-113 | MRNATEAYAKEVPHTITSVWTKGVTPPTPEQFTYYNEDVFHAPYLAHQGWYDITKTFNGKDNLLCGAATAGNM<br>LHWWFDQNKTEIEAYLSKHPEKQKIIFNNQELFDLKAAIDTKDSQTNSQLFNYFKDKAFPNLSARQLGVMPDL<br>VLDMFINGYYLNVFKTQSTDVNRPYQDKDKRGGIFDAVETRGDQTKLLTARHDLKNKGLNDISDLIKQELTEG<br>KALALSHTYANVSINHVINLWGADFNAEGNLEAIYVTDSDANASIGMKKYFVGINASGKVAISAKKIEGENIG<br>AQVLGLFTLSSGKDIWQKLS (SEQ ID NO: 168) |
| PRT-114 | MRNATEAYNEETPHQITSVWTKGVTPPTPEQFRYNNEDVIHAPYLANQGWYDITKTFNGKDNLLCGAATAGNM<br>LHWWFDQNKTEIEAYLSKHPEKQKIIFNNQELFDLKAAIDTKDSQTNSQLFNYFREKAFPNLSARQLGVMPDL<br>VLDMFINGYYLNVTKQSTDVNRPYQDKDKRGGIFDAVETRGDQTKLLTARHDLKNKTLNEISTLIKQELTEG<br>RALALSHTYANVSISHVINLWGADFNAEGNLEAIYVTDSDANASIGMKKYFVGVNAAGHVAISAKKIEGENIG<br>AQVLGLFTLSSGKDIWQKLS (SEQ ID NO: 169) |
| PRT-115 | MRNATEAYAKETPKTITSVWTKGVTPPTPEQFRYNGEDVIHAPYLAHQGWYDITKTFDGKDNLLCGAATAGNM<br>LHWWFDQNKTEIERYLKKHPEKQKIIFNNQELFDLKAAIDTKDSQTNSALFNYFRDKAFPNLSARQLGVMPDL<br>VLDMFINGYYLNVTKTQSTDVNRPYQTKDKRGGIFDAVFTRGDQTKLLTARHDLKNKTLNDISTLIKQELTEG<br>KALALSHTYANVSISHVINLWGADFNAEGNLEAIYVTDSDSNASIGMKKYFVGVNAAGKVAISAKKIKGENIG<br>AQVLGLFTLSSGKDIWQKLS (SEQ ID NO: 170) |
| PRT-116 | MRNATEAYNKATPTTITSVWTKGVTPPTPEQFRYNNEDVFHAPYKAHQGWYDITKTFNGKDNLLCGAATAGNM<br>LHWWFDQNKTEIEAYLSKHPEKQKIIFNNQELFDLKAAIDTKDSQTNSQLFNYERDKAFPNLSARQLGVMPDL<br>VLDMFINGYYLNVFKTQSTDVNRPYQDKDKRGGIFDAVETRGDQTKLLTARHDLKDKGLNEISDLIKQELTEG<br>KALALSHTYANVRISHVINLWGADFNAEGNLEAIYVTDSDANASIGMKKYFVGVNSSGHVAISAKKIEGENIG<br>AQVLGLFTLSSGKDIWQKLS (SEQ ID NO: 171) |
| PRT-117 | MRNATEAYAKEVPHTITSVWTKGVTPPTPEQFTYQNEDVFHAPYLANQGWYDITKTFNGKDNLLCGAATAGNM<br>LHWWFDQNKEEIERYLSKHPEKQKIIFNNQELFDLKAAIDTKDSQTNSALFNYERDKAFPNLSARQLGVMPDL<br>VLDMFINGYYLNVFKTQSTDVNRPYQDKDKRGGIFDAVFTRGDQTTLLTARHDLKNKGLNDISDLIKQELTEG |

TABLE 5-continued

| ID | Polypeptide having protease activity Seq |
|---|---|
| | KALALSHTYANVSISHVINLWGADFNAEGNLEAIYVTDSDANASIGMKKYFVGVNTAGKVAISAKKIEGENIG<br>AQVLGLFTLSSGKDIWEQLS (SEQ ID NO: 172) |
| PRT-118 | MRNATEAYNKETPKTITSVWTKGVTPPTPEQFTKQNEDVFHAPYVANQGWYDITKTENGKDNLLCGAATAGNM<br>LHWWFDQNKTEIENYLKKHPEKQKIIFNNQELFDLKAAIDTKDSQTNSALFNYFRDKAFPNLSARQLGVMPDH<br>VLDMFINGYYLNVNKTQSTDVNRPYDDKDKRGGIFDAVETRGDQTTLLTARHDLKNKGLNEISTLIKQELTEG<br>RALALSHTYANVSISHVINLWGADFNAEGNLEAIYVTDSDANASIGMKKYFVGKNASGKVAISAKKIEGDNIG<br>AQVLGLFTLSSGKDIWQKLS (SEQ ID NO: 173) |
| PRT-119 | MRNATEAYAKETPKQITSVWTKGVTPPTPEQFRYNNEDVFHAPYVANQGWYDITKTFDGKDNLLCGAATAGNM<br>LHWWFDQNKTEIEKYLSKHPEKQKIIFNNQELFDLKAAIDTKDSQTNSQLFNYFRDKAFPNLSARQLGVMPDL<br>VLDMFINGYYLNVTKTQSTDVNRPYQDKDKRGGIFDAVFTRGDQTKLLTARHDLGNKSLNEISQLIKQELQEG<br>KALALSHTYANVRISHVINLWGADFDAEGNLEAIYVTDSDSNASIGMKKYYVGVNSAGKVAISAKKIEGENIG<br>AQVLGLFTLSSGKDIWQKLS (SEQ ID NO: 174) |
| PRT-120 | MRNATEAYNEETPKQITSVWTKGVTPLTPEDFRYNNEDVFHAPYLANQGWYDITKTFNGKDNLLCGAATAGNM<br>LHWWFDQNKEEIEAYLKKHPEKQKIIFNNQELFDLKAAIDTKDSQTNSQLFNYFKDKAFPNLSARQLGVMPDL<br>VLDMFINGYYLNVNKTQSTDVNRPYQDKDKRGGIFDAVFTRGDQTKLLTERHDLKNKGLNDISTLIKQELTEG<br>KALALSHTYANVSISHVINLWGADFDAEGNLEAIYVTDSDSNESIGMKKYFVGINAAGKVAISAKKIEDENIG<br>AQVLGLFTLSSGKDIWQQLS (SEQ ID NO: 175) |
| PRT-121 | MRNATEAYNEDTPKQITSVWTKGVTPPTPEQFRKYNEDVLHAPYIANQGWYDITKTFNGKDDLLCGAATAGNM<br>LHWWFDQNKTEIEAYLSKYPEKQKIIFNNQELFDLRAAIDTKDSQTNSALFNYFRDKAFPNLSARQLGVMPDL<br>VLDMFINGYYLNVTKTQSTDVNRPYQTKDKRGGIFDAVFTRGDQTTLLTSRHDLKNKTLNEISDLIKQELTEG<br>KALALSHTYANVSISHVINLWGADFNAEGNLEAIYVTDSDANASIGMKKYFVGVNAAGKVAISAKKIEGENIG<br>AQVLGLFTLSTGKDIWEKLS (SEQ ID NO: 176) |
| PRT-122 | MRNATEAYAKEVPKKITSVWTKGVTPLTPEQFIYQNEDVFHAPYLAHQGWYDITKTFNGKDNLLCGAATAGNM<br>LHWWFDQNKEEIERYLSKHPEKQKIIFNNQELFDLKAAIDTKDSQTNSALFNYFRDKAFPNLSARQLGVMPDL<br>VLDMFINGYYLNVTKTQSTDVNRPYQTKDKRGGIFDAVFTRGDQTKLLTERHDLKNKTLEEISQLIKQELTEG<br>KALGLSHTYANVRISHVINLWGADFDAEGNLEAIYVTDSDSNASIGMKKYFVGVNASGKVAISAKKIEDDNIG<br>AQVLGLFTLSSGKDIWEKLS (SEQ ID NO: 177) |
| PRT-123 | MRNATEAYNKESPHTITSVWTKGVTPPTPEDFRYNNEDVLHAPYVANQGWYDITKTFDGKDNLLCGAATAGNM<br>LHWWFDQNKEEIERYLKKHPEKQKIIFNNQELFDVKAAIDTKDSQTNSKLFNYERDKAFPNLSARQLGVMPDL<br>VLDMFINGYYLNLGKTQSTDVNRPYQDKDKRGGIFDAVFTRGDQTTLLTARHDLKNKGLNEISDLIKQELTEG<br>KALALSHTYANVRINHVINLWGADFDAEGNLIAIYVTDSDANASIGMKKYFVGVNANGKVAISAKKIEGDNIG<br>AQVLGLFTLSTGQDIWQKLS (SEQ ID NO: 178) |
| PRT-124 | MRNATEAYAKEVPHQITSVWTKGVTPLTPEQFRYNNEDVIHAPYLAHQGWYDITKTFDGKDNLLCGAATAGNM<br>LHWWFDQNKTEIEAYLSKHPEKQKIIFNNQELFDLKAAIDTKDSQTNSQLFNYERDKAFPNLSARQLGVMPDL<br>VLDMFINGYYLNVFKTQSTDVNRPYQDKDKRGGIFDAVFTRGDQTTLLTARHDLKNKGLNDISTIIKQELTEG<br>KALALSHTYANVSISHVINLWGADENAEGNLEAIYVTDSDANASIGMKKYFVGVNAHGKVAISAKKIEGENIG<br>AQVLGLFTLSSGKDIWQKLS (SEQ ID NO: 179) |
| PRT-125 | MRNATEAYAKEVPHQITSVWTKGVTPLTPEQFRYNNEDVFHAPYLANQGWYDITKTFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTKLLTARHDLKNKGLNDISTLIKQELTEG<br>KALALSHTYANVSISHVINLWGADFNAEGNLEAIYVTDSDANASIGMKKYFVGVNAHGHVAISAKKIEGENIG<br>AQVLGLFTLSSGKDIWQKLS (SEQ ID NO: 180) |
| PRT-126 | MRNATEAYAKEVPHQITSVWTKGVTPLTPEQFRYNNEDVIHAPYLANQGWYDITKTFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTTLLTARHDLKNKGLNDISDLIKQELTEG<br>KALALSHTYANVSISHVINLWGADFNAEGNLEAIYVTDSDSNASIGMKKYFVGVNAAGHVAISAKKIEGENIG<br>AQVLGLFTLSSGKDIWQKLS (SEQ ID NO: 181) |
| PRT-127 | MRNATEAYAKEVPHQITSVWTKGVTPLTPEQFRYNNEDVIHAPYLANQGWYDITKTENGKDNLLCGAATAGNM<br>LHWWFDQNKTEIEAYLKKHPEKQKIIFNNQELFDLKAAIDTKDSQTNSQLFNYERDKAFPNLSARQLGVMPDL<br>VLDMFINGYYLNVFKTQSTDVNRPYQDKDKRGGIFDAVFTRGDQTTLLTARHDLKNKGLNEISTLIKQELTEG<br>KALALSHTYANVSISHVINLWGADFNAEGNLEAIYVTDSDSNASIGMKKYFVGVNAHGKVAISAKKIEGENIG<br>AQVLGLFTLSSGKDIWQKLS (SEQ ID NO: 182) |
| PRT-128 | MRNATEAYAKEVPKQITSVWTKGVTPPTPEQFRYNNEDVIHAPYLANQGWYDITKTFNGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTTLLTARHDLKNKTLNDISTLIKQELTEG<br>KALALSHTYANVSISHVINLWGADFNAEGNLEAIYVTDSDANASIGMKKYFVGVNAHGKVAISAKKIEGENIG<br>AQVLGLFTLSSGKDIWQKLS (SEQ ID NO: 183) |
| PRT-129 | MRNATEAYAKEVPHQITSVWTKGVTPLTPEQFRYNNEDVFHAPYLANQGWYDITKAFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVFTRGDQTKLLTARHDLKNKGLNDISTLIKQELTEG<br>RALALSHTYANVSISHVINLWGADFNAEGNLEAIYVTDSDANASIGMKKYFVGINAHGHVAISAKKIEGENIG<br>AQVLGLFTLSSGKDIWQKLS (SEQ ID NO: 184) |
| PRT-130 | MRNATEAYAKEVPHQITSVWTKGVTPLTPEQFRYNNEDVIHAPYLAHQGWYDITKAFDGKDNLLCGAATAGNM<br>LHWWFDQNKTEIEAYLSKHPEKQKIIFNNQELFDLKAAIDTKDSQTNSQLFNYFRDKAFPNLSARQLGVMPDL<br>VLDMFINGYYLNVFKTQSTDVNRPYQDKDKRGGIFDAVETRGDQTTLLTARHDLKNKGLNDISDIIKQELTEG |

TABLE 5-continued

| ID | Polypeptide having protease activity Seq |
|---|---|
| | RALALSHTYANVSISHVINLWGADFNAEGNLEAIYVTDSDSNASIGMKKYFVGINAAGHVAISAKKIEGENIG AQVLGLFTLSSGKDIWQKLS (SEQ ID NO: 185) |
| PRT-131 | MRNATEAYAKEVPHQITSVWTKGVTPLTPEQFRYNNEDVIHAPYLAHQGWYDITKAFNGKDNLLCGAATAGNM LHWWFDQNKTEIEAYLKKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNEISTIIKQELTEG RALALSHTYANVSISHVINLWGADFNAEGNLEAIYVTDSDANASIGMKKYFVGINAHGKVAISAKKIEGENIG AQVLGLFTLSSGKDIWQKLS (SEQ ID NO: 186) |
| PRT-132 | MRNATEAYAKEVPKQITSVWTKGVTPPTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYERDKAFPNLSARQLGVMPDL VLDMFINGYYLNVFKTQSTDVNRPYQDKDKRGGIFDAVFTRGDQTTLLTARHDLKNKTLNDISTIIKQELTEG RALALSHTYANVSISHVINLWGADENAEGNLEAIYVTDSDANASIGMKKYFVGINAHGHVAISAKKIEGENIG AQVLGLFTLSSGKDIWQKLS (SEQ ID NO: 187) |
| PRT-133 | MRNATEAYAKEVPHQITSVWTKGVTPLTPEQFRYNNEDVIHAPYLAHQGWYDITKTFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 188) |
| PRT-134 | MRNATEAYAKEVPHQITSVWTKGVTPLTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTLIKQELTEG RALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 189) |
| PRT-135 | MRNATEAYAKEVPHQITSVWTKGVTPLTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG KALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 190) |
| PRT-136 | MRNATEAYAKEVPHQITSVWTKGVTPLTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGVNAHGHVAISAKKIEGENIG AQVLGLFTLSSGKDIWQKLS (SEQ ID NO: 191) |
| PRT-137 | MRNATEAYAKEVPHQITSVWTKGVTPLTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYERDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVIDSDANASIGMKKYFVGINAHGKVAISAKKIEGENIG AQVLGLFTLSSGKDIWQKLS (SEQ ID NO: 192) |
| PRT-138 | MRNATEAYAKEVPHQITSVWTKGVTPPTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADENAEGNLEAIYVTDSDANASIGMKKYFVGINAHGHVAISAKKIEGENIG AQVLGLFTLSSGKDIWQKLS (SEQ ID NO: 193) |
| PRT-139 | MRNATEAYAKEVPHQITSVWTKGVTPLTPEQFRYNNEDVIHAPYLANQGWYDITKAFDGKDNLLCGAATAGNM LHWWFDQNKTEIEAYLSKHPEKQKIIFNNQELFDLKAAIDTKDSQTNSQLFNYERDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 194) |
| PRT-140 | MRNATEAYAKEVPHQITSVWTKGVTPLTPEQFRYNNEDVIHAPYLAHQGWYDITKAFNGKDNLLCGAATAGNM LHWWFDQNKTEIEAYLSKHPEKQKIIFNNQELFDLKAAIDTKDSQTNSQLFNYERDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 195) |
| PRT-141 | MRNATEAYAKEVPHQITSVWTKGVTPLTPEQFRYNNEDVIHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGINAAGHVAISAKKIEGENIG AQVLGLFTLSSGKDIWQKLS (SEQ ID NO: 196) |
| PRT-142 | MRNATEAYAKEVPHQITSVWTKGVTPLTPEQFRYNNEDVFHAPYLAHQGWYDITKAFDGKDNLLCGAATAGNM LHWWFDQNKTEIEAYLSKHPEKQKIIFNNQELFDLKAAIDTKDSQTNSQLFNYFRDKAFPNLSARQLGVMPDL VLDMFINGYYLNVFKTQSTDVNRPYQDKDKRGGIFDAVFTRGDQTTLLTARHDLKNKGLNDISTIIKQELTEG RALALSHTYANVSISHVINLWGADFNAEGNLEAIYVTDSDANASIGMKKYFVGINAHGHVAISAKKIEGENIG AQVLGLFTLSSGKDIWQKLS (SEQ ID NO: 197) |
| PRT-143 | MANQEIRYSEVTPYHITSVWTKGVTPPANFTQGEDVFHAPYVANQGWYDITKTFNGKDDLLCGAATAGNMLHW WFDQNKDQIKRYLEEHPEKQKINFNGEQMEDVKEAIDTKNHQLDSKLFEYFKEKAFPYLSTKHLGVFPDHVID MFINGYRLSLINHGPTPVKEGSKDPRGGIFDAVFTRGDQSKLLTSRHDFKEKTLNEISQLIKQELTEGKALGL |

TABLE 5-continued

| ID | Polypeptide having protease activity Seq |
|---|---|
| | SHTYANVRINHVINLWGADFDAEGNLEAIYVTDSDSNASIGMKKYFVGVNSAGKVAISAKEIKEDNIGAQVLG<br>LFTLSTGQDSWNQTN (SEQ ID NO: 198) |
| PRT-144 | MANQEIRYSEVTPYHITSVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKTLNDISQLIKQELQSGKALGL<br>SHTYANVRINHVINLWGADFDAEGNLEAIYVTDSDSNASIGMKKYFVGKNSAGKVAISAKEIKEDNIGAQVLG<br>LFTLSTGQDSWNQTN (SEQ ID NO: 199) |
| PRT-145 | MANQEIRYSEVTPYHITSVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKTLNTISQLIKQELQSGKALGL<br>SHTYANVRINHVINLWGADFDAEGNLEAIYVTDSDSNASIGMKKYFVGKNSAGKVAISAKEIKEDNIGAQVLG<br>LFTLSTGQDSWNQTN (SEQ ID NO: 200) |
| PRT-146 | MANQEIRYSEVTPYHIKTVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKTLNDISQLIKQELQSGKALGL<br>SHTYANVRINHVINLWGADFDAEGNLEAIYVTDSDSNASIGMKKYFVGKNSAGKVAISAKEIKEDNIGAQVLG<br>LFTLSTGQDSWNQTN (SEQ ID NO: 201) |
| PRT-147 | MANQEIRYSEVTPYHIKIVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKTLNDISQLIKQELQSGKALGL<br>SHTYANVRINHVINLWGADFDAEGNLEAIYVTDSDSNASIGMKKYFVGKNSAGKVAISAKEIKEDNIGAQVLG<br>LFTLSTGQDSWNQTN (SEQ ID NO: 202) |
| PRT-148 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKRQSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNKIN (SEQ ID NO: 203) |
| PRT-149 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLINHGPTPVKRQTKDPRGGIFDAVFGRGDQTKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQKSWNKTN (SEQ ID NO: 204) |
| PRT-150 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKRQEKDPRGGIFDAVEGRGDQTKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQKSWNKIN (SEQ ID NO: 205) |
| PRT-151 | MANQEIRYSEVTPYHVTSVWTKGVTPPANFTQGEDVFHAPYVANQGWYDITKTFNGKDDLLCGAATAGNMLHW<br>WFDQNKDQIKRYLEEHPDKQKINFNGEQMFDVKEAIDTKNHQLDSKLFEYFKEKAFPYLSTKHLGVFPDHVID<br>MFINGYRLSLINHGPTPVKRQTKDPRGGIFDAVFGRGDSTKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQKSWNKIN (SEQ ID NO: 206) |
| PRT-152 | MANQEIRYSEVTPYHVISVWTKGVTPPANFTQGEDVFHAPYVANQGWYDITKTFNGKDDLLCGAATAGNMLHW<br>WFDQNKTQIERYLKKHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGKDSWEKTN (SEQ ID NO: 207) |
| PRT-153 | MANQEIRYSEVTPYHVTSVWTKGVTPPANFTQGEDVFHAPYVANQGWYDITKTFNGKDDLLCGAATAGNMLHW<br>WFDQNKTQIERYLKKHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGKDSWKKIN (SEQ ID NO: 208) |
| PRT-154 | MANQEIRYSEVTPYHVISVWTKGVTPPANFTQGEDVFHAPYVANQGWYDITKTFNGKDDLLCGAATAGNMLHW<br>WFDQNKTQIEAYLKKHPEKQKINFNGEQMFDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGKKSWEKTN (SEQ ID NO: 209) |
| PRT-155 | MANQEIRYSEVTPYHVISVWTDGVTPPANFTQGEDVFHAPYVANQGWYDITKTFNGKDDLLCGAATAGNMLHW<br>WFDQNSTQIEAYLKKHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGKKSWEKIN (SEQ ID NO: 210) |
| PRT-156 | MANQEIRYSEVTPYHVISVWTKGVTPPTDFTQGEDVFHAPYKANQGWYDITKTENGKDDLLCGAATAGNMLHW<br>WFDQNKDQIKRYLEEHPEKQKINENGEQMFDVKEAIDTKNHQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL |

TABLE 5-continued

| ID | Polypeptide having protease activity Seq |
|---|---|
| | SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 211) |
| PRT-157 | MANQEIRYSEVTPYHVTSVWTKGVTPPEDFTQGEDVFHAPYKANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 212) |
| PRT-158 | MANQEIRYSEVTPYHVISVWTKGVTPPTDFIKGEDVFHAPYKAHQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELQEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 213) |
| PRT-159 | MANQEIRYSEVTPYHVISVWTKGVTPPTDFIKGEDVFHAPYKAGQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELQEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 214) |
| PRT-160 | MANQEIRYSEVTPYHVITVWTDGVKPPTDFIKGEDVFHAPYKAHQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELQEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 215) |
| PRT-161 | MANQEIRYSEVTPYHVTIVWTDGVKPPTDFIKGEDVFHAPYKAHQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELQEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 216) |
| PRT-162 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNSQTNSELFNYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 217) |
| PRT-163 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNDQTNSELFNYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 218) |
| PRT-164 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNSQENSELFNYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 219) |
| PRT-165 | MANQEIRYSEVTPYHVISVWTKGVTPPANFTQGEDVFHAPYVANQGWYDITKTENGGDDLLCGAATAGNMLHW<br>WFDQNKDQIKRYLEEHPEKQKINFNGEQMFDVKEAIDTKNSQTNSELFNYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 220) |
| PRT-166 | MANQEIRYSEVTPYHVISVWTKGVTPPANFTQGEDVFHAPYVANQGWYDITKAFDGGDDLLCGAATAGNMLHW<br>WFDQNKDQIKRYLEEHPEKQKINFNGEQMFDVKEAIDTKNSQTNSELFNYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 221) |
| PRT-167 | MANQEIRYSEVTPYHVISVWTKGVTPPTDFTQGEDVFHAPYKANQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 222) |
| PRT-168 | MANQEIRYSEVTPYHVISVWTKGVTPPEDFTQGEDVFHAPYKANQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 223) |
| PRT-169 | MANQEIRYSEVTPYHVISVWTKGVTPPTDFTQGEDVFHAPYKANQGWYDITKTFNGKDDLLCGAATAGNMLHW<br>WFDQNKDQIKRYLEEHPEKQKINFNGEQMFDVKEAIDTKNDQLDSKLFEYFKEKAFPYLSTKHLGVFPDHVID<br>MFINGYRLSLINHGPTPVKEGSKDPRGGIFDAVFTRGDQSKLLTSRHDFKEKNLKEISDLIKKELTEGKALGL |

TABLE 5-continued

| ID | Polypeptide having protease activity Seq |
|---|---|
| | SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 224) |
| PRT-170 | MANQEIRYSEVTPYHVISVWTKGVTPPTDFIKGEDVFHAPYKAHQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 225) |
| PRT-171 | MANQEIRYSEVTPYHVISVWTKGVTPPTDFIKGEDVFHAPYKAGQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 226) |
| PRT-172 | MANQEIRYSEVTPYHVISVWTKGVKPPTDFIKGEDVFHAPYKAHQGWYDITKTFNGKDDLLCGAATAGNMLHW<br>WFDQNKDQIKRYLEEHPEKQKINFNGEQMEDVKEAIDTKNSQLDSKLFEYFKEKAFPYLSTKHLGVFPDHVID<br>MFINGYRLSLINHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQIN (SEQ ID NO: 227) |
| PRT-173 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMEDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGKNASGKVAISAKEIEGENIGAQVLG<br>LFTLSTGQDSWNQTN (SEQ ID NO: 228) |
| PRT-174 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVETRGDQSKLLTSRHDFKEKNLKEISDLIKKELTEGKALGL<br>SHTYANVRINHVINLWGADFDSNGNLKAIYVTDSDSNASIGMKKYFVGKNASGKVAISAKEIEDENIGAQVLG<br>LFTLSTGQDSWNQTN (SEQ ID NO: 229) |
| PRT-175 | MANQEIRYSEVTPYHITSVWTKGVTPPTDFTQGEDVFHAPYKANQGWYDITKTFNGKDDLLCGAATAGNMLHW<br>WFDQNKTQIERYLKKHPEKQKINFNGEQMEDVKEAIDTKNSQTNSELFNYFKEKAFPYLSTKHLGVFPDHVID<br>MFINGYRLSLTNHGPTPVKRQSKDPRGGIFDAVFTRGDQSKLLTSRHDFKEKTLNEISQLIKQELTEGKALGL<br>SHTYANVRINHVINLWGADFDAEGNLEAIYVTDSDSNASIGMKKYFVGVNSAGKVAISAKEIKEDNIGAQVLG<br>LFTLSTGKDSWEKIN (SEQ ID NO: 230) |
| PRT-176 | MANQEIRYSEVTPYHITSVWTKGVTPPTDFIKGEDVFHAPYKAHQGWYDITKTENGGDDLLCGAATAGNMLHW<br>WFDQNKTQIEAYLKKHPEKQKINFNGEQMFDVKEAIDTKNSQTNSELFNYFKEKAFPYLSTKHLGVFPDHVID<br>MFINGYRLSLTNHGPTPVKRQTKDPRGGIFDAVFGRGDQTKLLTSRHDFKEKTLNDISQLIKQELQSGKALGL<br>SHTYANVRINHVINLWGADFDAEGNLEAIYVTDSDSNASIGMKKYFVGKNASGKVAISAKEIEDENIGAQVLG<br>LFTLSTGKKSWEKIN (SEQ ID NO: 231) |
| PRT-177 | MANQEIRYSEVTPYHIKTVWTDGVKPPTDFIKGEDVFHAPYKAHQGWYDITKAFDGGDDLLCGAATAGNMLHW<br>WFDQNSTQIEAYLKKHPDKQKINFNGEQMEDVKEAIDTKNSQTNSELFNYFKEKAFPYLSTKHLGVFPDHVID<br>MFINGYRLSLTNHGPTPVKRQTKDPRGGIFDAVFGRGDSTKLLTSRHDFKEKTLNDISQLIKQELQSGKALGL<br>SHTYANVRINHVINLWGADFDAEGNLEAIYVTDSDSNASIGMKKYFVGKNASGKVAISAKEIEDENIGAQVLG<br>LFTLSTGKKSWEKTN (SEQ ID NO: 232) |
| PRT-178 | MANQEIRYSEVTPYHVTSVWTKGVTPPANFTQGEDVFHAPYVANQGWYDITKTFNGKDDLLCGAATAGNMLHW<br>WFDQNKDQIKRYLEEHPEKQKIIFNNQELFDLKAAIDTKNHQLDSKLFEYFKEKAFPYLSTKHLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 233) |
| PRT-179 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSARQLGVFPDHVID<br>MFINGYRLSLTNHGPTPVKEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 234) |
| PRT-180 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNTQSTDVNEGSKDPRGGIFDAVFTRGDQSKLLTSRHDFKEKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 235) |
| PRT-181 | MANQEIRYSEVTPYHVISVWTKGVTPPANFTQGEDVFHAPYVANQGWYDITKTFNGKDDLLCGAATAGNMLHW<br>WFDQNKDQIKRYLEEHPEKQKINFNGEQMFDVKEAIDTKNHQLDSKLFEYFKEKAFPYLSTKHLGVFPDHVID<br>MFINGYRLSLTNHGPTPVKEGSKDPRGGIFDAVFTRGDQSKLLTSRHDLKNKNLKEISDLIKKELTEGKALGL<br>SHTYANVRINHVINLWGADFDSNGNLKAIYVTDSDSNASIGMKKYFVGVNSAGKVAISAKEIKEDNIGAQVLG<br>LFTLSTGQDSWNQTN (SEQ ID NO: 236) |

TABLE 5-continued

| ID | Polypeptide having protease activity Seq |
|---|---|
| PRT-182 | MANQEIRYSEVTPYHVISVWTKGVTPPANFTQGEDVFHAPYVANQGWYDITKTFNGKDDLLCGAATAGNMLHW WFDQNKDQIKRYLEEHPEKQKINFNGEQMEDVKEAIDTKNHQLDSKLFEYFKEKAFPYLSTKHLGVFPDHVID MFINGYRLSLTNHGPTPVKEGSKDPRGGIFDAVFTRGDQSKLLTSRHDFKEKNLKEISDLIKKELTEGKALGL SHTYANVRINHVINLWGADFDSNGNLKAIYVTDSDSNASIGMKKYFVGVNSAGKVAISAKKIKEDNIGAQVLG LFTLSTGQDSWNQTN (SEQ ID NO: 237) |
| PRT-183 | MRNATEAYAKEVPHQVTSVWTKGVTPPANFTQGEDVFHAPYVANQGWYDITKTFNGKDDLLCGAATAGNMLHW WFDQNKDQIKRYLEEHPEKQKINFNGEQMFDVKEAIDTKNHQLDSKLFEYFKEKAFPYLSTKHLGVFPDHVID MFINGYRLSLINHGPTPVKEGSKDPRGGIFDAVFTRGDQSKLLTSRHDFKEKNLKEISDLIKKELTEGKALGL SHTYANVRINHVINLWGADFDSNGNLKAIYVTDSDSNASIGMKKYFVGVNSAGKVAISAKEIKEDNIGAQVLG LFTLSTGQDSWNQTN (SEQ ID NO: 238) |
| PRT-184 | MANQEIRYSEVTPYHVISVWTKGVTPPANFTQGEDVFHAPYVANQGWYDITKTFNGKDDLLCGAATAGNMLHW WFDQNKDQIKRYLEEHPEKQKINFNGEQMFDVKEAIDTKNHQLDSKLFEYFKEKAFPYLSTKHLGVFPDHVID MFINGYRLSLINHGPTPVKEGSKDPRGGIFDAVFTRGDQSKLLTSRHDFKEKNLKEISDLIKKELTEGKALGL SHTYANVRINHVINLWGADFDSNGNLKAIYVTDSDSNASIGMKKYFVGVNSAGKVAISAKEIKEDNIGAQVLG LFTLSTGQDSWQKLS (SEQ ID NO: 239) |
| PRT-185 | MANQEIRYSEVTPYHVISVWTKGVTPPANFrQGEDVFaAPYVANQGWYDITKTENGKDDLLCGAATAGNMLHW WFDQNKDQIKRYLEEHPEKQKINFNGEQMFDVKEIntyesdhgyrdkskLFEYFKEKAFPYLSTKHLGVFPDH VIDMFINGYRLSLINHGPTPVKEGSKDPRGGIFDAVFTRGDQSKLLTSRHDFKEKNLKEISDLIKKELTEGKA LGLSHTYANVRINHVINLWGADFDSNGNLKAIYVTDSDdkkltigderIGMKKYFVGVNSAGKVAISAKEIKE DNIGAQVLGLFTLSTGQDSWNQTN (SEQ ID NO: 240) |
| PRT-186 | MANQEIRYSEVTPYHVISVWTKGVTPPANFrkivdgniayyHAPYVANQGWYDITKTFNGKDDLLCGAATAGN MLHWWFDQNKDQIKRYLEEHPEKQKINFNGEQMFDVKEAIDTKNHQLDSKLFEYFKEKAFPYLSTKHLGVFPD HVIDMFINGYRLSLTNHGPTPVKEGSKDPRGGIFDAVFTRGDQSKLLTSRHDFKEKNLKEISDLIKKELTEGK ALGLSHTYANVRINHVINLWGADFDSNGNLKAIYVTDSDSNASIGMKKYFVGVNSAGKVAISAKEIKEDNIGA QVLGLFTLSTGQDSWNQTN (SEQ ID NO: 241) |
| PRT-187 | MANQEIRYSEVTPYHVISVWTKGVTPPADFTYGEDVFHAPYVANQGWYDITKTFNGKDDLLCGAATAGNMLHW WFDQNKEQIEKYLKKHPEKQKIMFGDQELLDVRKVINTKGSQTNSELFNYFRDKAFPGLSARRLGVMPDLVLD MFINGYYLNVYKTQTTDVNRTYQEKDKRGGIFDAVFTRGDQSKLLTSRHDFKEKNLKEISDLIKQELTEGKAL GLSHTYANVRINHVINLWGADFDSNGNLKAIYVTDSDSNASIGMKKYFVGVNSAGKVAISAKEIKEDNIGAQV LGLFTLSTGQDIWNQIN (SEQ ID NO: 242) |
| PRT-188 | MANQEIRYSEVTPYHVISVWTKGVTPPANFrkivdgniayyaAPYVANQGWYDITKTFNGKDDLLCGAATAGN MLHWWFDQNKDQIKRYLEEHPEKQKINFNGEQMFDVKElntyesdhgyrdkskLFEYFKEKAFPYLSTKHLGV FPDHVIDMFINGYRLSLINHGPTPVKEGSKDPRGGIFDAVETRGDQSKLLTSRHDFKEKNLKEISDLIKKELT EGKALGLSHTYANVRINHVINLWGADFDSNGNLKAIYVTDSDdkkltigderIGMKKYFVGVNSAGKVAISAK EIKEDNIGAQVLGLFTLSTGQDSWNQTN (SEQ ID NO: 243) |
| PRT-189 | MANQEIRYSEVTPYHVTSVWTKGVTPPDHDFANFTQGEDVFHAPYVANQGWYDITKTFNGKDDLLCGAATAGN MLHWWFDQNKDQIKRYLEEHPEKQKINFNGEQMFDVKEAIDTKNHQLDSKLFEYFKEKAFPYLSTKHLGVFPD HVIDMFINGYRLSLINHGPTPVKEGSKDPRGGIFDAVETRGDQSKLLTSRHDFKEKNLKEISDLIKKELTEGK ALGLSHTYANVRINHVINLWGADFDSNGNLKAIYVTDSDSNASIGMKKYFVGVNSAGKVAISAKEIKEDNIGA QVLGLFTLSTGQDSWNQTN (SEQ ID NO: 244) |
| PRT-190 | MANQEIRYSEVTPYHVTSVWTKGVTPPDHDFRKIVDGEDVFHAPYVANQGWYDITKTENGKDDLLCGAATAGN MLHWWFDQNKDQIKRYLEEHPEKQKINFNGEQMFDVKEAIDTKNHQLDSKLFEYFKEKAFPYLSTKHLGVFPD HVIDMFINGYRLSLINHGPTPVKEGSKDPRGGIFDAVFTRGDQSKLLTSRHDFKEKNLKEISDLIKKELTEGK ALGLSHTYANVRINHVINLWGADFDSNGNLKAIYVTDSDSNASIGMKKYFVGVNSAGKVAISAKEIKEDNIGA QVLGLFTLSTGQDSWNQTN (SEQ ID NO: 245) |
| PRT-191 | MANQEIRYSEVTPYHVISVWTKGVTPPANFTQGEDVFHAPYVANQGWYDITKTFNGKDDLLCGAATAGNMLHW WFDQNKDQIKRYLEEHPEKQKINFNGEQMEDVKEAIDTKNHQLDSKLFEYFKEKAFPYLSTKHLGVFPDHVID MFINGYRLSLTNHGPTPVKEGSKDPRGGIFDAVFTRGDQSKLLTSRHDFKEKNLKEISDLIKKELTEGKALGL SHTYANVRHSINHVINLWGADFDSNGNLKAIYVTDSDSNASIGMKKYFVGVNSAGKVAISAKEIKEDNIGAQV LGLFTLSTGQDSWNQTN (SEQ ID NO: 246) |
| PRT-192 | MANQEIRYSEVTPYHVISVWTKGVTPPANFTQGEDVFHAPYVANQGWYDITKTFNGKDDLLCGAATAGNMLHW WFDQNKDQIKRYLEEHPEKQKINFNGEQMEDVKEAIDTKNHQLDSKLFEYFKEKAFPYLSTKHLGVFPDHVID MFINGYRLSLINHGPTPVKEGSKDPRGGIFDAVFTRGDQSKLLTSRHDFKEKNLKEISDLIKKELTEGKALGL SHTYANVRINHVINLWGADFDSNGNLKAIYVTDSDDKKLTISNASIGMKKYFVGVNSAGKVAISAKEIKEDNI GAQVLGLFTLSTGQDSWNQTN (SEQ ID NO: 247) |
| PRT-193 | MANQEIRYSEVTPYHVISVWTKGVTPPANFTQGEDVFHAPYVANQGWYDITKTFNGKDDLLCGAATAGNMLHW WFDQNKDQIKRYLEEHPEKQKINFNGEQMFDVKEAIDTKNHQLDSKLFEYFKEKAFPYLSTKHLGVFPDHVID MFINGYRLSLINHGPTPVKEGSKDPRGGIFDAVFTRGDQSKLLTSRHDFKEKNLKEISDLIKKELTEGKALGL SHTYANVRINHVINLWGADFDSNGNLKAIYVTDSDDKKLTIGDERIGMKKYFVGVNSAGKVAISAKEIKEDNI GAQVLGLFTLSTGQDSWNQTN (SEQ ID NO: 248) |
| PRT-194 | MANQEIRYSEVTPYHVTSVWTKGVTPPDHDFANFTQGEDVFHAPYVANQGWYDITKTFNGKDDLLCGAATAGN MLHWWFDQNKDQIKRYLEEHPEKQKINFNGEQMFDVKEAIDTKNHQLDSKLFEYFKEKAFPYLSTKHLGVFPD HVIDMFINGYRLSLTNHGPTPVKEGSKDPRGGIFDAVFTRGDQSKLLTSRHDFKEKNLKEISDLIKKELTEGK ALGLSHTYANVRHSINHVINLWGADFDSNGNLKAIYVTDSDDKKLTISNASIGMKKYFVGVNSAGKVAISAKE IKEDNIGAQVLGLFTLSTGQDSWNQTN (SEQ ID NO: 249) |

TABLE 5-continued

| ID | Polypeptide having protease activity Seq |
|---|---|
| PRT-195 | MANQEIRYSEVTPYHVISVWTKGVTPPDHDFRKIVDGEDVFHAPYVANQGWYDITKTFNGKDDLLCGAATAGN<br>MLHWWFDQNKDQIKRYLEEHPEKQKINFNGEQMFDVKEAIDTKNHQLDSKLFEYFKEKAFPYLSTKHLGVFPD<br>HVIDMFINGYRLSLTNHGPTPVKEGSKDPRGGIFDAVFTRGDQSKLLTSRHDFKEKNLKEISDLIKKELTEGK<br>ALGLSHTYANVRHSINHVINLWGADFDSNGNLKAIYVTDSDDKKLTIGDERIGMKKYFVGVNSAGKVAISAKE<br>IKEDNIGAQVLGLFTLSTGQDSWNQTN (SEQ ID NO: 250) |
| PRT-196 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIIYVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 251) |
| PRT-197 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDELN<br>TYESDHGYRDKSKLFDFISNNENGPVWTDKLLDNYINGYAYNYKYGRTIEDPTKNTSKINFFKEVENEKILTN<br>NHSIRNQNEFSDLLSEALYTGKAIGLSYGPAGLRHSLGHIISVWGADLDADGNVVAIYVTDSDDKKLTIGDER<br>VGLKRYKISTDDENRARLTAYEETDNTGGQIRGLYTLDTGKQAWADYFDKTEQTGTDQAEQLEHHHHHH<br>(SEQ ID NO: 252) |
| PRT-198 | MEVVEVWPYGQNPNGKTEILSQTEDSESLQRLRDIEDFQAEKKKQGVVYTKWLDGVDVKDHDERKIVDGNIAY<br>YATPLLNGRGFYDINKDENRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVENEKILIN<br>NHSIRNQNEFSDLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLYTLDTGKQAWADYFDKTEQTGTDQAEQLEHHHHHH<br>(SEQ ID NO: 253) |
| PRT-199 | MEVVEVWPYGQNPNGKTEILSQTEDSESLQRLRDIEDFQAEKKKQNVVYTKWLDGVDVKDHDERKIVDGNIAY<br>YATPLLNGRGFYDINKDFNRDSDKCAAAVAANMFHYWLDRNRDNVDRFLRQNPEKHGIIELPDGQLKLSDFLN<br>TYESDDGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDEGRLRLTAYEETHNTGGQIRGLWTLDTGKQAWADYFDKTEQTGTDQAEQLEHHHHHH<br>(SEQ ID NO: 254) |
| PRT-200 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVENEKILTN<br>NHSIRNQNEFSDLLSEALYTGKAIGLSYGPAGLRHSLGHIISVWGADLDADGNVVAIYVTDSDDKKLTIGDER<br>VGLKRYKISTDDENRARLTAYEETDNTGGQIRGLWTLDTGKQAWADYFDKTEQTGTDQAEQLEHHHHHH<br>(SEQ ID NO: 255) |
| PRT-201 | MEVVEVWPYGQNPNGKTEILSQTEDSESLQRLRDIEDFQAEKKKQNVVYTKWLDGVDVKDHDERKIKDGNIEY<br>YATPLLNGRGFYDINKDENRDSDKCAAAVAANMFHYWLDINRDNVDRFLRQNPEKHGIIELPDGQLKLSDFLN<br>TYESDDGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDEGRARLTAYEETHNTGGQIRGLYTLDTGKQAWADYFDKTEQTGTDQAEQLEHHHHHH<br>(SEQ ID NO: 256) |
| PRT-202 | MEVVEVWPYGQNPNGKTEILSQTEDSESLQRLRDIEDFQAEKKKQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDYGYRDKSKLFDFISNNFNGPVWTDKLLDNYINGYAYNYKYGRTIEDPTKNTSKINFFKKVFNEKILTN<br>IHSIRNQNEFSDLLSEALYTGKAIGLSYGPAGLRHSLGHIISVWGADLDADGNVVAIYVTDSDDKKLTIGDER<br>VGLKRYKISTDDEGRLRLTAYEETDNTGGEIRGLYTLDTGKQAWADYFDKTEQTGTDQAEQLEHHHHHH<br>(SEQ ID NO: 257) |
| PRT-203 | MEVVEVWPYGQNPNGKTEILSQTEDSESLQRLRDIEDFQAEKKKQNVVYTKWLDGVDVKDHDERKIKDGNIEY<br>YATPLLNGRGFYDINKDFNRDSDKCAAAVAANMFHYWLDRNRDNVDRFLRQNPEKHGIIELPDGQLKLSDFLN<br>TYESDDGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDEGRARLTAYEETHNTGGQIRGLWTLDTGKQAWADYFDKTEQTGTDQAEQLEHHHHHH<br>(SEQ ID NO: 258) |
| PRT-204 | MEVVEVWPYGQNPNGKTEILSQTEDSESLQRLRDIEDFQAEKKMQNVVYTKWLDGVTVKDHDFRKIVDGNIAY<br>YATPLLNGRGFYDINKDFNRDSDKCAAAVAANMFHYWLDINRDNVDRFLSQNPEKHGIIELPDGQLKLSDFLN<br>TYESDNGYRDKSKLFDFISNNFNGPVWTDKLLDNYINGYAYNYKYGRTIEDPTKNTSKINFFKEVFNEKILTN<br>IHSIRNQNEFSDLLSEALYTGKAIGLSYGPAGLRHSLGHIISVWGADLDADGNVVAIYVTDSDDKKLTIGDER<br>VGLKRYKISTDDEGRARLTAYEETDNTGGQIRGLETLDTGKYAWADYFDKTEQTGTDQAEQLEHHHHHH<br>(SEQ ID NO: 259) |
| PRT-205 | MEVVEVWPYGQNPNGKTEILSQTEDSESLQRLRDIEDFQAEKKKEGVVYTKWLDGVDVDDHDERKIVDGNIAY<br>YATPLLNGRGFYDINKDFNRDSDKCAAAVAANMFHYWLDRNRDNVDRFLKQNPEKHGIIELPDGQLKLSDFLN<br>TYESDNGYRDKSKLFDFISNNFNGPVWTDKLLDNYINGYAYNYKYGRTIEDPTKNTSKINFFKEVENEKILIN<br>NHSIRNYNTFSDLLSEALYTGKAIGLSYGPAGLRHSLGHIISVWGADLDADGNVVAIYVTDSDDKKLTIGDER<br>VGLKRYKVSSDDENRLRLTAYEETHNTGGQIRGIYTLDTGKQAWADYFDKTEQTGTDQAEQLEHHHHHH<br>(SEQ ID NO: 260) |

TABLE 5-continued

| ID | Polypeptide having protease activity Seq |
|---|---|
| PRT-206 | MEVVEVWPYGQNPNGKTEILSQTEDSESLQRLRDIEDFQAEKKKENVVYTKWLDGVTVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDDGYRDKSKLFDFISNNFNGPVWTDKLLDNYINGYGYNYKYGRTIEDPTKNTSKINFFKEVENEKILTD<br>NHSIRDQNEFSDLLSEALYTGKAIGLSYGPAGLRHSLGHIISVWGADLDADGNVVAIYVTDSDDKKLTIGDER<br>VGLKRYKISYDDEGRARLTAYEEKDNTGGQIRGLYTLDTGKQAWADYFDKTEQTGTDQAEQLEHHHHHH<br>(SEQ ID NO: 261) |
| PRT-207 | MEVVEVWPYGQNPNGKTEILSQTEDSESLQRLRDIEDFQAEKKKEGVVYTKWLDGVDVDDHDFRKIVDGNIAY<br>YATPLLNGRGFYDINKDENRDSDKCAAAVAANMFHYWLDRNRDNVDRFLKQNPEKHGIIELPDGQLKLSDFLN<br>TYESDNGYRDKSKLFDFISNNFNGPVWTDKLLDNYINGYAYNYKYGRTIEDPTKNTSKINFFKEVENEKILTD<br>NHSIRNYNTFSDLLSEALYTGKAIGLSYGPAGLRHSLGHIISVWGADLDADGNVVAIYVTDSDDKKLTIGDER<br>VGLKRYKVSSDDENRLRLTAYEETHNTGGQIRGIWTLDTGKQAWADYFDKTEQTGTDQAEQLEHHHHHH<br>(SEQ ID NO: 262) |
| PRT-208 | MEVVEVWPYGQNPNGKTEILSQTEDSESLQRLRDIEDFQAEKKKENVVYTKWLDGVTVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDDGYRDKSKLFDFISNNENGPVWTDKLLDNYINGYGYNYKYGRTIEDPTKNTSKINFFKEVENEKILTD<br>NHSIRDQNEFSDLLSEALYTGKAIGLSYGPAGLRHSLGHIISVWGADLDADGNVVAIYVTDSDDKKLTIGDER<br>VGLKRYKISYDDEGRARLTAYEEKDNTGGQIRGLWTLDTGKQAWADYFDKTEQTGTDQAEQLEHHHHHH<br>(SEQ ID NO: 263) |
| PRT-209 | MEVVEVWPYGQNPNGKTEILSQTEDSESLQRLRDIEDFQAEKKKQGVVYTKWLDGVDVDDHDERKIVDGNIAY<br>YATPLLNGKGFYDINKDENRDSDKCAAAVAANMFHYWLDQNRDNVDRFLRQNPEKHGIIELPDGQLKLSDFLN<br>TYESDNGYRDKSKLFDFISNNFNGPVWTDKLLDNYINGYAYNYKYGRTIEDPTKNTSKINFFKDVFNEKILIN<br>IHSIRNYNTFSNLLSEALYTGKAIGLSYGPAGLRHSLGHIISVWGADLDEDGNVVAIYVTDSDDKKLTIGDER<br>VGLKRYKISTDDEGRARLTAYEENDNTGGEIRGLYTLDTGKQAWADYFDKTEQTGTDQAEQLEHHHHHH<br>(SEQ ID NO: 264) |
| PRT-210 | MEVVEVWPYGQNPNGKTEILSQTEDSESLQRLRDIEDFQAEKKKQNVVYTKWLDGVTVDDHDFRKITDGNTAY<br>YATPLLNGRGFYDINKDENRDSDKCAAAVAANMFHYWLDQNRDNVDRFLKQNPEKHGIIELPDGQLKLSDELN<br>TYESDDGYRDKSKLFDFISNNFNGPVWTDKLLDNYINGYAYNYKYGRTIEDPTKNTSKINFFKEVFNEKLLTN<br>NHSIRNQNEFSDLLSEALYTGKAIGLSYGPAGLRHSLGHIISVWGADFDADGNVVAIYVTDSDDKKLTIGDER<br>VGLKRYKISSDDEGRARLTAYTEKHNTGGQIRGLYTLDTGKQEWADYFDKTEQTGTDQAEQLEHHHHHH<br>(SEQ ID NO: 265) |
| PRT-211 | MEVVEVWPYGQNPNGKTEILSQTEDSESLQRLRDIEDFQAEKKKQGVVYTKWLDGVDVDDHDERKIVDGNIAY<br>YATPLLNGKGFYDINKDENRDSDKCAAAVAANMFHYWLDQNRDNVDRFLRQNPEKHGIIELPDGQLKLSDFLN<br>TYESDNGYRDKSKLFDFISNNFNGPVWTDKLLDNYINGYAYNYKYGRTIEDPTKNTSKINFFKDVENEKILIN<br>IHSIRNYNTFSNLLSEALYTGKAIGLSYGPAGLRHSLGHIISVWGADLDEDGNVVAIYVTDSDDKKLTIGDER<br>VGLKRYKISTDDEGRARLTAYEENDNTGGEIRGLWTLDTGKQAWADYFDKTEQTGTDQAEQLEHHHHHH<br>(SEQ ID NO: 266) |
| PRT-212 | MEVVEVWPYGQNPNGKTEILSQTEDSESLQRLRDIEDFQAEKKKEGVVYTKWLDGVDVKDHDFRKIVDGNIEY<br>YATPLLNGRGFYDINKDFNQDSDKCAAAVAANMFHYWLDRNRDNVDRFLSQNPEKHGIIELPDGQLKLSDFLN<br>TYESDDGYRDKSKLFDLISNNFNGPVWTDKLLDNYINGYAYNYKYGRTIEDPTKNTSKINFFKEVFNEKILIN<br>IHSIRNQNEFSDKLSEALYTGKAIGLSYGPAGLRHSLGHIISVWGADLDEDGNVVAIYVTDSDDKKLTIGDER<br>VGLKRYKVSTDDEGRLRLTAYEETDNTGGEIRGIWTLDTGKQAWADYFDKTEQTGTDQAEQLEHHHHHH<br>(SEQ ID NO: 267) |
| PRT-213 | MEVVEVWPYGQNPNGKTEILSQTEDSESLQRLRDIEDFQAEKKKEGVVYTKWLDGVTVKDHDERKIVDGNIEY<br>YATPLLNGRGWYDINKDENRDSDKCAAAVAANMFHYWLDRNRDNVDRELKQNPEKHGIIELPDGQLKLSDELN<br>TYESDNGYRDKSKLFDFISKNFNGPVWTDKLLDNYINGYGYNYKYGRTIEDPTKNTSKINFFKKVFNEKILTD<br>IHSIRNQNEFSDLLSEALYTGKAIGLSYGPAGLRHSLGHIISVWGADEDEDGNVVAIYVTDSDDKKLTIGDER<br>VGLKRYKVSTDDEGRARLTAYTETDNTGGQVRGLYTLDTGTQAWADYFDKTEQTGTDQAEQLEHHHHHH<br>(SEQ ID NO: 268) |
| PRT-214 | MEVVEVWPYGQNPNGKTEILSQTEDSESLQRLRDIEDFQAEKKKEGVVYTKWLDGVDVDDHDFRKITDGDIEY<br>YATPLLNGRGFYDINKDENRDSDKCAAAVAANMFHYWLDRNRDNVDRFLKQNPEKHGIIELPDGQLKLSDFLN<br>TYESDYGYRDKSKLFDFISNNFNGPVWTDKLLDNYINGYAYNYKYGRTIEDPTKNTSKINFFKEVEDEKLLTN<br>NHSIRNYNEFSELLREALYTGKAIGLSYGPAGLRHSLGHIISVWGADLDEDGNVVAIYVTDSDDKKLTIGDER<br>VGLKRYKVSSDDENRARLTAYEEKDNTGGEIRGLYTLDTGKQAWADYFDKTEQTGTDQAEQLEHHHHHH<br>(SEQ ID NO: 269) |
| PRT-215 | MEVVEVWPYGQNPNGKTEILSQTEDSESLQRLRDIEDFQAEKKKEGVVYTKWLDGVTVKDHDERKIVDGNIEY<br>YATPLLNGRGWYDINKDFNRDSDKCAAAVAANMFHYWLDRNRDNVDRFLKQNPEKHGIIELPDGQLKLSDFLN<br>TYESDNGYRDKSKLFDFISKNFNGPVWTDKLLDNYINGYGYNYKYGRTIEDPTKNTSKINFFKKVFNEKILTD<br>IHSIRNQNEFSDLLSEALYTGKAIGLSYGPAGLRHSLGHIISVWGADFDEDGNVVAIYVTDSDDKKLTIGDER<br>VGLKRYKVSTDDEGRARLTAYTETDNTGGQVRGLWTLDTGTQAWADYFDKTEQTGTDQAEQLEHHHHHH<br>(SEQ ID NO: 270) |
| PRT-216 | MEVVEVWPYGQNPNGKTEILSQTEDSESLQRLRDIEDFQAEKKKENVVYTKWLDGVDVDDHDFRKIVDGNTEY<br>YATPLLNGRGWYDINKDFNRDSDKCAAAVAANMFHYWLDQNRDNVDRFLRQSPEKHGIIELPDGQLKLSDFLN<br>TYESDDGYRDKSKLFDFISNNFNGPVWTDKLLDNYINGYGYNYKYGRTIEDPTKNNSKINFFKKVENGKILTD<br>NHSIRNYNTFSDLLSEALYTGKAIGLSYGPAGLRHSLGHIISVWGADLDADGNVVAIYVTDSDDKKLTIGDER<br>VGLKRYKISYDDENRARLTAYEENDNTGGQIRGLETLDTGKQAWADYFDKTEQTGTDQAEQLEHHHHHH<br>(SEQ ID NO: 271) |

TABLE 5-continued

| ID | Polypeptide having protease activity Seq |
|---|---|
| PRT-217 | MEVVEVWPYGQNPNGKTEILSQTEDSESLQRLRDIEDFQAEKKKQNVVYTKWLDGVTVDDSDERKIKDGNTEY<br>YATPLLNGRGFYDINKDENRDSDKCAAAVAANMFHYWLDRNRDNVDRFLKQNPEKHGIIELPDGQLKLSDFLN<br>TYESDNNYRDKSKLFDFISKNFNGPVWTNKLLDNYINGYGYNYKYGRTIEDPTKNTSKINFFKKVFNEKILTN<br>VHQIFNYNEFSTLLSEALYTGKAIGLSYGPGGLRHSLGHIISVWGADLDADGNVVAIYVTDSDDKKLTIGDER<br>VGLKRYKISTDDEGRARLTAYTETDNTGGQVRGIYTLDTGKQAWADYFDKTEQTGTDQAEQLEHHHHHH<br>(SEQ ID NO: 272) |
| PRT-218 | MEVVEVWPYGQNPNGKTEILSQTEDSESLQRLRDIEDFQAEKKKQGVVYTKWLDGVNVDDHEFRKITDGNTEY<br>YATPLLNGRGYYDINKDFNRDSDKCAAAVAANMFHYWLDRNRDNVDRFLRQNPDKHGIIELPDGQLKLSDFLN<br>TYESDHDYRDKSKLFDFISNNFNGPVWINKLLDNYINGYGYNYKYGRTIEDPTKNTSKINFFKEVENGKLLTD<br>NHSIRNKNEFSSKLSEALYTGKAIGLSYGPAGLRHSLGHIISVWGADLDEDGNVVAIYVTDSDDKKLTIGDER<br>VGLKRYKVSYDDEGRARLTAYEETDNTGGEIRGLYTLDTGKQYWADYFDKTEQTGTDQAEQLEHHHHHH<br>(SEQ ID NO: 273) |
| PRT-219 | MEVVEVWPYGQNPNGKTEILSQTEDSESLQRLRDIEDFQAEKKKQNVVYTKWLDGVTVDDSDERKIKDGNTEY<br>YATPLLNGRGFYDINKDFNRDSDKCAAAVAANMFHYWLDRNRDNVDRFLKQNPEKHGIIELPDGQLKLSDFLN<br>TYESDNNYRDKSKLFDFISKNFNGPVWINKLLDNYINGYGYNYKYGRTIEDPTKNTSKINFFKKVENEKILTN<br>VHQIFNYNEFSTLLSEALYTGKAIGLSYGPGGLRHSLGHIISVWGADLDADGNVVAIYVTDSDDKKLTIGDER<br>VGLKRYKISTDDEGRARLTAYTETDNTGGQVRGIWTLDTGKQAWADYFDKTEQTGTDQAEQLEHHHHHH<br>(SEQ ID NO: 274) |
| PRT-220 | MEVVEVWPYGQNPNGKTEILSQTEDSESLQRLRDIEDFQAEKKKQGVVYTKWLDGVNVDDHEFRKITDGNTEY<br>YATPLLNGRGYYDINKDFNRDSDKCAAAVAANMFHYWLDRNRDNVDRFLRQNPDKHGIIELPDGQLKLSDFLN<br>TYESDHDYRDKSKLFDFISNNFNGPVWINKLLDNYINGYGYNYKYGRTIEDPTKNTSKINFFKEVENGKLLTD<br>NHSIRNKNEFSSKLSEALYTGKAIGLSYGPAGLRHSLGHIISVWGADLDEDGNVVAIYVTDSDDKKLTIGDER<br>VGLKRYKVSYDDEGRARLTAYEETDNTGGEIRGLWTLDTGKQYWADYFDKTEQTGTDQAEQLEHHHHHH<br>(SEQ ID NO: 275) |
| PRT-221 | MEVVEVWPYGQNPNGKTEILSQTEDSESLQRLRDIEDFQAEKKMQNVVYTKWLDGVDVKDHDFRKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVENEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKQAWADYFDKTEQTGTDQAEQLEHHHHHH<br>(SEQ ID NO: 276) |
| PRT-222 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDENRDSDKCAAAVAANMFHYWLDINRDNVDRELRQNPEKHGIIELPDGQLKLSDELN<br>TYESDHGYRDKSKLFDFISNNFNGPVWTDKLLDNYINGYAYNYKYGRTIEDPTKNTSKINFFKEVENEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDEGRLRLTAYEETHNTGGQIRGLWTLDTGKYAWADYFDKTEQTGTDQAEQLEHHHHHH<br>(SEQ ID NO: 277) |
| PRT-223 | MEVVEVWPYGQNPNGKTEILSQTEDSESLQRLRDIEDFQAEKKKENVVYTKWLDGVDVKDHDFRKIVDGNIAY<br>YATPLLNGRGFYDINKDFNRDSDKCAAAVAANMFHYWLDINRDNVDRFLRQNPEKHGIIELPDGQLKLSDELN<br>TYESDHGYRDKSKLFDFISNNFNGPVWTDKLLDNYINGYAYNYKYGRTIEDPTKNTSKINFFKEVENEKILTN<br>NHSIRNQNEFSDLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWILDTGKQAWADYFDKTEQTGTDQAEQLEHHHHHH<br>(SEQ ID NO: 278) |
| PRT-224 | MEVVEVWPYGQNPNGKTEILSQTEDSESLQRLRDIEDFQAEKKKQNVVYTKWLDGVDVKDHDERKIVDGNIAY<br>YATPLLNGRGFYDINKDENRDSDKCAAAVAANMFHYWLDINRDNVDRFLRQNPEKHGIIELPDGQLKLSDELN<br>TYESDHGYRDKSKLFDFISNNFNGPVWTDKLLDNYINGYAYNYKYGRTIEDPTKNTSKINFFKEVFNEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDEGRLRLTAYEETHNTGGQIRGLWTLDTGKQAWADYFDKTEQTGTDQAEQLEHHHHHH<br>(SEQ ID NO: 279) |
| PRT-225 | MEVVEVWPYGQNPNGKTEILSQTEDSESLQRLRDIEDFQAEKKKENVVYTKWLDGVDVKDHDERKIVDGNIEY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRARLTAYEETDNTGGQIRGLWILDTGKQAWADYFDKTEQTGTDQAEQLEHHHHHH<br>(SEQ ID NO: 280) |
| PRT-226 | MEVVEVWPYGQNPNGKTEILSQTEDSESLQRLRDIEDFQAEKKKQNVVYTKWLDGVDVDDHDERKIVDGNTEY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTNKLLDNYINGYGYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDEGRARLTAYEETDNTGGQIRGLWTLDTGKQAWADYFDKTEQTGTDQAEQLEHHHHHH<br>(SEQ ID NO: 281) |
| PRT-227 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLYTLDTGKYAWADYFDKTEQTGTDQAEQLEHHHHHH<br>(SEQ ID NO: 282) |

TABLE 5-continued

| ID | Polypeptide having protease activity Seq |
|---|---|
| PRT-228 | MEVVEVWPYGQNPNGKTEILSQTEDSESLQRLRDIEDFQAEKKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSDLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 283) |
| PRT-229 | MEVVEVWPYGQNPNGKTEILSQTEDSESLQRLRDIEDFQAEKKKQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 284) |
| PRT-230 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDELN<br>TYESDNGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 285) |
| PRT-231 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDINRDNVDRFLRQNPEKHGIIELPDGQLKLSDELN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRARLTAYEETHNTGGQIRGLWTLDTGKYAWADYFDKTEQTGTDQAEQLEHHHHHH<br>(SEQ ID NO: 286) |
| PRT-232 | MEVVEVWPYGQNPNGKTEILSQTEDSESLQRLRDIEDFQAEKKMQNVVYTKWLDGVDVKDHDFRKIVDGNIAY<br>YATPLLNGRGFYDINKDENRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKEAWADYFDKTEQTGTDQAEQLEHHHHHH<br>(SEQ ID NO: 287) |
| PRT-233 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDFNRDSDKCAAAVAANMFHYWLDRNRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWILDTGKYAWADYFDKTEQTGTDQAEQLEHHHHHH<br>(SEQ ID NO: 288) |
| PRT-234 | MEVVEVWPYGQNPNGKTEILSQTEDSESLQRLRDIEDFQAEKKMQNVVYTKWLDGVDVKDHDFRKIVDGNIAY<br>YATPLLNGRGFYDINKDFNRDSDKCAAAVAANMFHYWLDINRDNVDRFLRQNPEKHGIIELPDGQLKLSDFLN<br>TYESDDGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 289) |
| PRT-235 | MEVVEVWPYGQNPNGKTEILSQTEDSESLQRLRDIEDFQAEKKMQNVVYTKWLDGVDVKDHDERKIVDGNIAY<br>YATPLLNGRGFYDINKDENRDSDKCAAAVAANMFHYWLDINRDNVDRFLRQNPEKHGIIELPDGQLKLSDELN<br>TYESDHGYRDKSKLFDFISNNFNGPVWTDKLLDNYINGYAYNYKYGRTIEDPTKNTSKINFFKEVFNEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETDNTGGQIRGLWTLDTGKYAWADYFDKTEQTGTDQAEQLEHHHHHH<br>(SEQ ID NO: 290) |
| PRT-236 | MEVVEVWPYGQNPNGKTEILSQTEDSESLQRLRDIEDFQAEKKMQNVVYTKWLDGVDVDDHDERKIVDGNIAY<br>YATPLLNGRGFYDINKDENRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 291) |
| PRT-237 | MEVVEVWPYGQNPNGKTEILSQTEDSESLQRLRDIEDFQAEKKMQNVVYTKWLDGVDVKDHDERKIVDGNIEY<br>YATPLLNGRGFYDINKDFNRDSDKCAAAVAANMFHYWLDINRDNVDRFLRQNPEKHGIIELPDGQLKLSDFLN<br>TYESDHGYRDKSKLFDFISNNFNGPVWTDKLLDNYINGYAYNYKYGRTIEDPTKNTSKINFFKEVENEKILTN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWILDTGKYAWADYFDKTEQTGTDQAEQLEHHHHHH<br>(SEQ ID NO: 292) |
| PRT-238 | MEVVEVWPYGQNPNGKTEILSQTEDSESLQRLRDIEDFQAEKKMQNVVYTKWLDGVDVKDHDFRKIVDGGIAY<br>YATPLLNGRGFYDINKDENRDSDLCAAAVAANMFHYWLDINRDNVDRFLRQNPEKHGIIELPDGQLKLSDFLN<br>TYESDHGYRDKSKLFDYISNNFNGPVWTDKLLDNYINGYGYNYKYGRTIEDPTKNTSKINFFKEVFNEKILIN<br>NHSIRNQNEFSVLLSEALYTGKAIGLSYGPAGLRHSLGHIISVWGADLDADGNVVAIYVTDSDDKKLTIGDER<br>VGLKRYKISTDDENRLRLTAYEETHNTGGQIRGLWTLDTGKYAWADYFDKTEQTGTDQAEQLEHHHHHH<br>(SEQ ID NO: 293) |

TABLE 5-continued

| ID | Polypeptide having protease activity Seq |
|---|---|
| PRT-239 | MEVVEVWPYGQNPNGKTEILSQTEDSESLQRLRDIEDFQAEKKMQNVVYTKWLDGVDVKDHDFRKIVDGGTAY YATPLLNGRGFYDINKDENRDSLLCSAAVAANMFHYWLDINRDNVDRFLRQNPEKHGIIELPDGQLKLSDFLN TYESDHGYRDKSKLFDYISNNENGGLWTDKLLDNYINGYGYNKKYGRTIEDPTKNTSKINFFKEVENEKILIN NHQIRNQNEFSVLLSEALYTGKAIGLSYGPAGLRHSLGHIISVWGADLDADGNVVAIYVTDSDDKKLTIGDER VGLKRYKISTDDNNRLRLTAYEETHNTGGQIRGLWTLDTGKYAWADYFDKTEQTGTDQAEQLEHHHHHH (SEQ ID NO: 294) |
| PRT-240 | MEVVEVWPYGQNPNGKTEILSQTEDSESLQRLRDIEDFQAEKKMQNVVYTKWLDGVDVKDHDERKIVDGDYAY YATPLLNGRGFYDINKDFNRSDKCAAAVAANMFHYWLDINRDNVDRFLRQNPEKHGIIELPDGQLKLSDELN TYESDHGYRDKSKLFDFISNAFNGPVWADKLLDNYINGYGYNKKYGRTIEDPTKNTSKFNFFKEVFNEKILTN NHQIRNQNEFSVLLSEALYTGKAIGLAYGPGGLRHSLGHIISVWGADLDADGNVVAIYVTDSDDKKLTIGDER VGLKRYKISTDDNNRLRLTTYEETHNTGAQIRGLETLDTGKYAWADYFDKTEQTGTDQAEQLEHHHHHH (SEQ ID NO: 295) |
| PRT-241 | MVTSVWTKGVTPPANFTQGEDVFHAPYVANQGWYDITKTFNGKDDLLCGAATAGNMLHWWFDQNKDQIKRYLE EHPEKQKINFNGEQMFDVKEAIDTKNHQLDSKLFEYFKEKAFPNLSTKHLGVFPDHVIDMFINGYRLSLLNHG PTPVKEGSKDPRGGIFDAVFTRGDQSKLLTSRHDFKEKNLKEISDLIKKELTEGKALGLSHTYANVRINHVIN LWGADFDSNGNLKAIYVTDSDSNASIGMKKYFVGVNSSGKVAISAKEIKEDNIGAQVLGLFTLSTGQDSWNQT N (SEQ ID NO: 296) |
| PRT-242 | MVTSVWTKGVTPPANFTQGEDVFHAPYVANQGWYDITKTFNGKDDLLCGAATAGNMLHWWFDQNKDQIKRYLE EHPEKQKINFNGEQMFDVKEAIDTKNHQLDSKLFDYFKEKAFPNLSTKHLGVFPDHVIDMFINGYRLSLLNHG PTPVKEGSKDPRGGIFDAVFTRGDQSKLLTSRHDFKEKNLKEISDLIKKELTEGKALGLSHTYANVRINHVIN LWGADFDSNGNLKAIYVTDSDSNPSIGMKKYFVGVNSSGKVAISAKEIKEDNIGAQVLGLFTLSTGQDSWNQT N (SEQ ID NO: 297) |
| PRT-243 | MVTSVWTKGVTPPANFTQGEDVFHAPYVANQGWYDITKLFNGKDDLLCGAATAGNMLHWWFDQNKDQIKRYLE EHPEKQKINFNGEQMFDVKEAIDTKNHQLDSKLFDYFKEKAFPNLSTKHLGVFPDHVIDMFINGYRLSLLNHG PTPVKEGSKDPRGGIFDAVFTRGDQSKLLTSRHDFKEKNLKEISDLIKKELTEGKALGLSHTYANGRINHVIN LWGADFDSNGNLKAIYVTDSDSNPSIGMKKYFVGVNSSGKVAISAKEIKEDNIGAQVLGLFTLSTGQDSWNQT N (SEQ ID NO: 298) |
| PRT-244 | MVTSVWTKGVTPPANFTQGEDVFHAPYVANQGWYDITKTFNGKDDLLCGAATAGNMLHWWFDQNKDQIKRYLE EHPEKQKINFNGEQMFDVKEAIDTKNHQLDSKLFEYFLEKAFPNLSTKHLGVFPDHVIDMFINGYRLSLLNHG PTPVKEGSKDPRGGIFDAVFTRGDQSKLLTSRHDFKEKNLKEISDLIKKELTEGKALGLSHTYANVRINHVIN LWGADFDSNGNLKAIAVTDSDSNASIGMKKYFVGVNSSGKVAISAKEIKEDNIGAQVLGLFTLSTGQDSWNQT N (SEQ ID NO: 299) |
| PRT-245 | MVTSVWTKGVTPPANFTQGEDVFHAPYVANQGWYDITKLFNGKDDLLCGAATAGNMLHWWFDQNKDQIKRYLE EHPEKQKINFNGEQMFDVKEAIDTKNHQLDSKLFEYFLEKAFPNLSTKHLGVFPDHVIDMFINGYRLSLLNHG PTPVKEGSKDPRGGIFDAVFTRGDQSKLLTSRHDFKEKNLKEISDLIKKELTEGKALGLSHTYANGRINHVIN LWGADFDSNGNLKAIAVTDSDSNASIGMKKYFVGVNSSGKVAISAKEIKEDNIGAQVLGLFTLSTGQDSWNQT N (SEQ ID NO: 300) |
| PRT-246 | MVTSVWTKGVTPPANFTQGEDVFHAPYVANQGWYDITKLFNGKDDLLCGAATAGNMLHWWFDQNKDQIKRYLE EHPEKQKINFNGEQMFDVKEAIDTKNHQLDSKLFDYFKEKAFPYLSTKHLGVFPDHVIDMFINGYRLSLINHG PTPVKEGSKDPRGGIFDAVETRGDQSKLLTSRHDFKEKNLKEISDLIKKELTEGKALGLSHTYANVRINHVIN LWGADFDSNGNLKAIYVTDSDSNPSIGMKKYFVGVNSSGKVAISAKEIKEDNIGAQVLGLFTLSTGQDSWNQT N (SEQ ID NO: 301) |
| PRT-247 | MVTSVWTKGVTPPANFTQGEDVFHAPYVANQGWYDITKLFNGKDDLLCGAATAGNMLHWWFDQNKDQIKRYLE EHPEKQKINFNGEQMEDVKEAIDTKNHQLDSKLFEYFLEKAFPYLSTKHLGVFPDHVIDMFINGYRLSLINHG PTPVKEGSKDPRGGIFDAVETRGDQSKLLTSRHDFKEKNLKEISDLIKKELTEGKALGLSHTYANVRINHVIN LWGADFDSNGNLKAIAVTDSDSNASIGMKKYFVGVNSSGKVAISAKEIKEDNIGAQVLGLFTLSTGQDSWNQT N (SEQ ID NO: 302) |
| PRT-248 | MVTSVWTKGVTPPTNFTYGEDVLHAPYVANQGWYDITKTFNGKDDLLCGAATAGNMLHWWFDQNKEQIENYLK KHPEKQKINFNGEQMFDVKEAIDTKDSQLDSKLFEYFKEKAFPNLSTKHLGVFPDHVIDMFINGYRLSLLNHG PTPVKRGSKDPRGGIFDAVFTRGDQSKLLTNRHDFKEKTLKEISDLIKQELTEGKALGISHTYANVRINHVIN LWGADFDAEGNLEAIYVTDSDSNASIGMKKYFVGVNSSGKVAISAKEIEEDNIGAQVLGLFTLSTGQDIWNQT N (SEQ ID NO: 303) |
| PRT-249 | MVTSVWTKGVTPPTNFTYGEDVLHAPYVANQGWYDITKTFNGKDDLLCGAATAGNMLHWWFDQNKEQIENYLK KHPEKQKINFNGEQMFDVKEAIDTKDSQLDSKLFDYFKEKAFPNLSTKHLGVFPDHVIDMFINGYRLSLLNHG PTPVKRGSKDPRGGIFDAVFTRGDQSKLLTNRHDFKEKTLKEISDLIKQELTEGKALGISHTYANVRINHVIN LWGADFDAEGNLEAIYVTDSDSNPSIGMKKYFVGVNSSGKVAISAKEIEEDNIGAQVLGLFTLSTGQDIWNQT N (SEQ ID NO: 304) |
| PRT-250 | MVTSVWTKGVTPPTNFTYGEDVLHAPYVANQGWYDITKLFNGKDDLLCGAATAGNMLHWWFDQNKEQIENYLK KHPEKQKINFNGEQMFDVKEAIDTKDSQLDSKLFDYFKEKAFPNLSTKHLGVFPDHVIDMFINGYRLSLLNHG PTPVKRGSKDPRGGIFDAVFTRGDQSKLLTNRHDFKEKTLKEISDLIKQELTEGKALGISHTYANGRINHVIN LWGADFDAEGNLEAIYVTDSDSNPSIGMKKYFVGVNSSGKVAISAKEIEEDNIGAQVLGLFTLSTGQDIWNQT N (SEQ ID NO: 305) |

TABLE 5-continued

| ID | Polypeptide having protease activity Seq |
|---|---|
| PRT-251 | MVTSVWTKGVTPPTNFTYGEDVLHAPYVANQGWYDITKTFNGKDDLLCGAATAGNMLHWWFDQNKEQIENYLK<br>KHPEKQKINFNGEQMEDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVRINHVIN<br>LWGADFDAEGNLEAIAVTDSDSNASIGMKKYFVGVNSSGKVAISAKEIEEDNIGAQVLGLFTLSTGQDIWNQT<br>N (SEQ ID NO: 306) |
| PRT-252 | MVTSVWTKGVTPPTNFTYGEDVLHAPYVANQGWYDITKLFNGKDDLLCGAATAGNMLHWWFDQNKEQIENYLK<br>KHPEKQKINFNGEQMEDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANGRINHVIN<br>LWGADFDAEGNLEAIAVTDSDSNASIGMKKYFVGVNSSGKVAISAKEIEEDNIGAQVLGLFTLSTGQDIWNQT<br>N (SEQ ID NO: 307) |
| PRT-253 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNKSIGMKKYFVGVNSDGKVAISAKEIEEDNIGAQVLGLFTLSTGQDIWNQT<br>N (SEQ ID NO: 308) |
| PRT-254 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNKSIGMKKYPVGVNSNGKVAISAKEIEEDNIGAQVLGLFTLSTGQDIWNQT<br>N (SEQ ID NO: 309) |
| PRT-255 | MVTSVWTKGVTPPTNFTYGEDVLHAPYVANQGWYDITKTFNGKDDLLCGAATAGNMLHWWFDQNKEQIENYLK<br>KHPEKQKINFNGEQMEDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVGINHVIN<br>LWGADFDAEGNLEAIAVTDSDSNASIGMKKYFVGVNSSGKVAISAKEIEEDNIGAQVLGLFTLSTGQDIWNQT<br>N (SEQ ID NO: 310) |
| PRT-256 | MVTSVWTKGVTPPTNFTYGEDVLHAPYVANQGWYDITKLFNGKDDLLCGAATAGNMLHWWFDQNKEQIENYLK<br>KHPEKQKINFNGEQMFDVKEAIDTKDSQLDSKLFEYFLEKAFPNLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVGINHVIN<br>LWGADFDAEGNLEAIAVTDSDSNASIGMKKYFVGVNSSGKVAISAKEIEEDNIGAQVLGLFTLSTGQDIWNQT<br>N (SEQ ID NO: 311) |
| PRT-257 | MVTSVWTKGVTPPTNFTYGEDVLHAPYVANQGWYDITKLFNGKDDLLCGAATAGNMLHWWFDQNKEQIENYLK<br>KHPEKQKINFNGEQMEDVKEAIDTKDSQLDSKLFDYFKEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNPSIGMKKYFVGVNSSGKVAISAKEIEEDNIGAQVLGLFTLSTGQDIWNQT<br>N (SEQ ID NO: 312) |
| PRT-258 | MVTSVWTKGVTPPTNFTYGEDVLHAPYVANQGWYDITKLFNGKDDLLCGAATAGNMLHWWFDQNKEQIENYLK<br>KHPEKQKINFNGEQMEDVKEAIDTKDSQLDSKLFEYFLEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIAVTDSDSNASIGMKKYFVGVNSSGKVAISAKEIEEDNIGAQVLGLFTLSTGQDIWNQT<br>N (SEQ ID NO: 313) |
| PRT-259 | MVTSVWTKGVTPPTNFTYGEDVLHAPYVANQGWYDITKTFNGKDNLLCGAATAGNMLHWWFDQNKEQIENYLK<br>KHPEKQKINFNGEQLFDVKEAIDTKDSQLDSKLFEYFKEKAFPNLSTKHLGVFPDHVIDMFINGYRLSLLNHG<br>PTPVKRGSKDKRGGIFDAVFTRGVQSKLLTNRHDFKEKTLKEISDLIKQELTEGKALGISHTYANVRINHVIN<br>LWGADFDAEGNLEAIYVTDSDTNASIGMKKYFVGVNSSGKVAISAKEIEEDNIGAQVLGLFTLSTGQDIWNQT<br>N (SEQ ID NO: 314) |
| PRT-260 | MVTSVWTKGVTPPTNFTYGEDVLHAPYVANQGWYDITKTFNGKDNLLCGAATAGNMLHWWFDQNKEQIENYLK<br>KHPEKQKINFNGEQLFDVKEAIDTKDSQLDSKLFDYFKEKAFPNLSTKHLGVFPDHVIDMFINGYRLSLLNHG<br>PTPVKRGSKDKRGGIFDAVFTRGVQSKLLTNRHDFKEKTLKEISDLIKQELTEGKALGISHTYANVRINHVIN<br>LWGADFDAEGNLEAIYVTDSDTNPSIGMKKYFVGVNSSGKVAISAKEIEEDNIGAQVLGLFTLSTGQDIWNQT<br>N (SEQ ID NO: 315) |
| PRT-261 | MVTSVWTKGVTPPTNFTYGEDVLHAPYVANQGWYDITKLFNGKDNLLCGAATAGNMLHWWFDQNKEQIENYLK<br>KHPEKQKINFNGEQLFDVKEAIDTKDSQLDSKLFDYFKEKAFPNLSTKHLGVFPDHVIDMFINGYRLSLLNHG<br>PTPVKRGSKDKRGGIFDAVFTRGVQSKLLTNRHDFKEKTLKEISDLIKQELTEGKALGISHTYANGRINHVIN<br>LWGADFDAEGNLEAIYVTDSDTNPSIGMKKYFVGVNSSGKVAISAKEIEEDNIGAQVLGLFTLSTGQDIWNQT<br>N (SEQ ID NO: 316) |
| PRT-262 | MVTSVWTKGVTPPTNFTYGEDVLHAPYVANQGWYDITKTFNGKDNLLCGAATAGNMLHWWFDQNKEQIENYLK<br>KHPEKQKINFNGEQLFDVKEAIDTKDSQLDSKLFEYFLEKAFPNLSTKHLGVFPDHVIDMFINGYRLSLLNHG<br>PTPVKRGSKDKRGGIFDAVFTRGVQSKLLTNRHDFKEKTLKEISDLIKQELTEGKALGISHTYANVRINHVIN<br>LWGADFDAEGNLEAIAVTDSDTNASIGMKKYFVGVNSSGKVAISAKEIEEDNIGAQVLGLFTLSTGQDIWNQT<br>N (SEQ ID NO: 317) |
| PRT-263 | MVTSVWTKGVTPPTNFTYGEDVLHAPYVANQGWYDITKLFNGKDNLLCGAATAGNMLHWWFDQNKEQIENYLK<br>KHPEKQKINFNGEQLFDVKEAIDTKDSQLDSKLFEYFLEKAFPNLSTKHLGVFPDHVIDMFINGYRLSLLNHG<br>PTPVKRGSKDKRGGIFDAVFTRGVQSKLLTNRHDFKEKTLKEISDLIKQELTEGKALGISHTYANGRINHVIN<br>LWGADFDAEGNLEAIAVTDSDTNASIGMKKYFVGVNSSGKVAISAKEIEEDNIGAQVLGLFTLSTGQDIWNQT<br>N (SEQ ID NO: 318) |

TABLE 5-continued

| ID | Polypeptide having protease activity Seq |
|---|---|
| PRT-264 | MVTSVWTKGVTPPTNFTYGEDVLHAPYVANQGWYDITKLFNGKDNLLCGAATAGNMLHWWFDQNKEQIENYLK KHPEKQKINFNGEQLFDVKEAIDTKDSQLDSKLFDYFKEKAFPYLSTKHLGVFPDHVIDMFINGYRLSLINHG PTPVKRGSKDKRGGIFDAVFTRGVQSKLLTNRHDFKEKTLKEISDLIKQELTEGKALGISHTYANVRINHVIN LWGADFDAEGNLEAIYVTDSDINPSIGMKKYFVGVNSSGKVAISAKEIEEDNIGAQVLGLFTLSTGQDIWNQT N (SEQ ID NO: 319) |
| PRT-265 | MVTSVWTKGVTPPTNFTYGEDVLHAPYVANQGWYDITKLFNGKDNLLCGAATAGNMLHWWFDQNKEQIENYLK KHPEKQKINFNGEQLFDVKEAIDTKDSQLDSKLFEYFLEKAFPYLSTKHLGVFPDHVIDMFINGYRLSLINHG PTPVKRGSKDKRGGIFDAVFTRGVQSKLLTNRHDFKEKTLKEISDLIKQELTEGKALGISHTYANVRINHVIN LWGADFDAEGNLEAIAVTDSDTNASIGMKKYFVGVNSSGKVAISAKEIEEDNIGAQVLGLFTLSTGQDIWNQT N (SEQ ID NO: 320) |
| PRT-266 | MVTSVWTKGVTPPTDFIYGEDVLHAPYKAGQGWYDITKTFNGKDDLLCGAATAGNMLHWWFDQNKEQIENYLK KHPEKQKINFNGEQMFDVKEAIDTKDSQLDSKLFEYFKEKAFPNLSTKHLGVFPDHVIDMFINGYRLSLLNHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNASIGMKKYFVGVNSSGKVAISAKEIEEDNIGAQVLGLFTLSTGQDIWNQT N (SEQ ID NO: 321) |
| PRT-267 | MVTSVWTKGVTPPTDFIYGEDVLHAPYKAGQGWYDITKTFNGKDDLLCGAATAGNMLHWWFDQNKEQIENYLK KHPEKQKINFNGEQMFDVKEAIDTKDSQLDSKLFDYFKEKAFPNLSTKHLGVFPDHVIDMFINGYRLSLLNHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNPSIGMKKYFVGVNSSGKVAISAKEIEEDNIGAQVLGLFTLSTGQDIWNQT N (SEQ ID NO: 322) |
| PRT-268 | MVTSVWTKGVTPPTDFIYGEDVLHAPYKAGQGWYDITKLFNGKDDLLCGAATAGNMLHWWFDQNKEQIENYLK KHPEKQKINFNGEQMFDVKEAIDTKDSQLDSKLFDYFKEKAFPNLSTKHLGVFPDHVIDMFINGYRLSLLNHG PTPVKRGSKDPRGGIFDAVFTRGDQSKLLTNRHDLKNKTLKEISDLIKQELTEGKALGISHTYANGRINHVIN LWGADFDAEGNLEAIYVTDSDSNPSIGMKKYFVGVNSSGKVAISAKEIEEDNIGAQVLGLFTLSTGQDIWNQT N (SEQ ID NO: 323) |
| PRT-269 | MVTSVWTKGVTPPTDFIYGEDVLHAPYKAGQGWYDITKTFNGKDDLLCGAATAGNMLHWWFDQNKEQIENYLK KHPEKQKINFNGEQMFDVKEAIDTKDSQLDSKLFEYFLEKAFPNLSTKHLGVFPDHVIDMFINGYRLSLLNHG PTPVKRGSKDPRGGIFDAVFTRGDQSKLLTNRHDLKNKTLKEISDLIKQELTEGKALGISHTYANVRINHVIN LWGADFDAEGNLEAIAVTDSDSNASIGMKKYFVGVNSSGKVAISAKEIEEDNIGAQVLGLFTLSTGQDIWNQT N (SEQ ID NO: 324) |
| PRT-270 | MVTSVWTKGVTPPTDFIYGEDVLHAPYKAGQGWYDITKLFNGKDDLLCGAATAGNMLHWWFDQNKEQIENYLK KHPEKQKINFNGEQMEDVKEAIDTKDSQLDSKLFEYFLEKAFPNLSTKHLGVFPDHVIDMFINGYRLSLLNHG PTPVKRGSKDPRGGIFDAVFTRGDQSKLLTNRHDLKNKTLKEISDLIKQELTEGKALGISHTYANGRINHVIN LWGADFDAEGNLEAIAVTDSDSNASIGMKKYFVGVNSSGKVAISAKEIEEDNIGAQVLGLFTLSTGQDIWNQT N (SEQ ID NO: 325) |
| PRT-271 | MVTSVWTKGVTPPTDFIYGEDVLHAPYKAGQGWYDITKLFNGKDDLLCGAATAGNMLHWWFDQNKEQIENYLK KHPEKQKINFNGEQMFDVKEAIDTKDSQLDSKLFDYFKEKAFPYLSTKHLGVFPDHVIDMFINGYRLSLINHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNPSIGMKKYFVGVNSSGKVAISAKEIEEDNIGAQVLGLFTLSTGQDIWNQT N (SEQ ID NO: 326) |
| PRT-272 | MVTSVWTKGVTPPTDFIYGEDVLHAPYKAGQGWYDITKLFNGKDDLLCGAATAGNMLHWWFDQNKEQIENYLK KHPEKQKINFNGEQMEDVKEAIDTKDSQLDSKLFEYFLEKAFPYLSTKHLGVFPDHVIDMFINGYRLSLINHG PTPVKRGSKDPRGGIFDAVFTRGDQSKLLTNRHDLKNKTLKEISDLIKQELTEGKALGISHTYANVRINHVIN LWGADFDAEGNLEAIAVTDSDSNASIGMKKYFVGVNSSGKVAISAKEIEEDNIGAQVLGLFTLSTGQDIWNQT N (SEQ ID NO: 327) |
| PRT-273 | MVTSVWTKGVTPPTDFIYGEDVLHAPYKAGQGWYDITKTFNGKDNLLCGAATAGNMLHWWFDQNKEQIENYLK KHPEKQKIIFNNQELFDLKAAIDTKDSQLDSKLFEYFKEKAFPNLSTKHLGVFPDHVIDMFINGYRLSLLNHG PTPVKRGSKDKRGGIFDAVFTRGVQSKLLTNRHDLKNKTLKEISDLIKQELTEGKALGISHTYANVRINHVIN LWGADFDAEGNLEAIYVTDSDTNASIGMKKYFVGVNSSGKVAISAKEIEEDNIGAQVLGLFTLSTGQDIWNQT N (SEQ ID NO: 328) |
| PRT-274 | MVTSVWTKGVTPPTDFIYGEDVLHAPYKAGQGWYDITKTFNGKDNLLCGAATAGNMLHWWFDQNKEQIENYLK KHPEKQKIIFNNQELFDLKAAIDTKDSQLDSKLFDYFKEKAFPNLSTKHLGVFPDHVIDMFINGYRLSLLNHG PTPVKRGSKDKRGGIFDAVFTRGVQSKLLTNRHDLKNKTLKEISDLIKQELTEGKALGISHTYANVRINHVIN LWGADFDAEGNLEAIYVTDSDTNPSIGMKKYFVGVNSSGKVAISAKEIEEDNIGAQVLGLFTLSTGQDIWNQT N (SEQ ID NO: 329) |
| PRT-275 | MVTSVWTKGVTPPTDFIYGEDVLHAPYKAGQGWYDITKLFNGKDNLLCGAATAGNMLHWWFDQNKEQIENYLK KHPEKQKIIFNNQELFDLKAAIDTKDSQLDSKLFDYFKEKAFPNLSTKHLGVFPDHVIDMFINGYRLSLLNHG PTPVKRGSKDKRGGIFDAVFTRGVQSKLLTNRHDLKNKTLKEISDLIKQELTEGKALGISHTYANGRINHVIN LWGADFDAEGNLEAIYVTDSDTNPSIGMKKYFVGVNSSGKVAISAKEIEEDNIGAQVLGLFTLSTGQDIWNQT N (SEQ ID NO: 330) |
| PRT-276 | MVTSVWTKGVTPPTDFIYGEDVLHAPYKAGQGWYDITKTFNGKDNLLCGAATAGNMLHWWFDQNKEQIENYLK KHPEKQKIIFNNQELFDLKAAIDTKDSQLDSKLFEYFLEKAFPNLSTKHLGVFPDHVIDMFINGYRLSLLNHG PTPVKRGSKDKRGGIFDAVFTRGVQSKLLTNRHDLKNKTLKEISDLIKQELTEGKALGISHTYANVRINHVIN LWGADFDAEGNLEAIAVTDSDTNASIGMKKYFVGVNSSGKVAISAKEIEEDNIGAQVLGLFTLSTGQDIWNQT N (SEQ ID NO: 331) |

TABLE 5-continued

| ID | Polypeptide having protease activity Seq |
|---|---|
| PRT-277 | MVTSVWTKGVTPPTDFIYGEDVLHAPYKAGQGWYDITKLFNGKDNLLCGAATAGNMLHWWFDQNKEQIENYLK KHPEKQKIIFNNQELFDLKAAIDTKDSQLDSKLFEYFLEKAFPNLSTKHLGVFPDHVIDMFINGYRLSLLNHG PTPVKRGSKDKRGGIFDAVFTRGVQSKLLTNRHDLKNKTLKEISDLIKQELTEGKALGISHTYANGRINHVIN LWGADFDAEGNLEAIAVTDSDTNASIGMKKYFVGVNSSGKVAISAKEIEEDNIGAQVLGLFTLSTGQDIWNQT N (SEQ ID NO: 332) |
| PRT-278 | MVTSVWTKGVTPPTDFIYGEDVLHAPYKAGQGWYDITKLFNGKDNLLCGAATAGNMLHWWFDQNKEQIENYLK KHPEKQKIIFNNQELFDLKAAIDTKDSQLDSKLFDYFKEKAFPYLSTKHLGVFPDHVIDMFINGYRLSLINHG PTPVKRGSKDKRGGIFDAVFTRGVQSKLLTNRHDLKNKTLKEISDLIKQELTEGKALGISHTYANVRINHVIN LWGADFDAEGNLEAIYVTDSDTNPSIGMKKYFVGVNSSGKVAISAKEIEEDNIGAQVLGLFTLSTGQDIWNQT N (SEQ ID NO: 333) |
| PRT-279 | MVTSVWTKGVTPPTDFIYGEDVLHAPYKAGQGWYDITKLFNGKDNLLCGAATAGNMLHWWFDQNKEQIENYLK KHPEKQKIIFNNQELFDLKAAIDTKDSQLDSKLFEYFLEKAFPYLSTKHLGVFPDHVIDMFINGYRLSLINHG PTPVKRGSKDKRGGIFDAVFTRGVQSKLLTNRHDLKNKTLKEISDLIKQELTEGKALGISHTYANVRINHVIN LWGADFDAEGNLEAIAVTDSDTNASIGMKKYFVGVNSSGKVAISAKEIEEDNIGAQVLGLFTLSTGQDIWNQT N (SEQ ID NO: 334) |
| PRT-280 | MVTSVWTKGVTPPAKFTQGEDVFHAPYVANQGWYDITKTFNGKDDLLCGAATAGNMLHWWFDQNKEKIEAYLK KHPDKQKIMFGDQELLDVRKVINTKGDQTNSELFNYFRDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVGINHV INLWGADFDSNGNLKAIYVTDSDSNASIGMKKYFVGVNSSGKVAISAKEIKEDNIGAQVLGLFTLSTGQDSWN QTN (SEQ ID NO: 335) |
| PRT-281 | MVTSVWTKGVTPPAKFTQGEDVFHAPYVANQGWYDITKTFNGKDDLLCGAATAGNMLHWWFDQNKEKIEAYLK KHPDKQKIMFGDQELLDVRKVINTKGDQTNSELFNYFRDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRIGHV INLWGADFDSNGNLKAIYVTDSDSNASIGMKKYFVGVNSSGKVAISAKEIKEDNIGAQVLGLFTLSTGQDSWN QTN (SEQ ID NO: 336) |
| PRT-282 | MVTSVWTKGVTPPAKFTQGEDVFHAPYVANQGWYDITKTFNGKDDLLCGAATAGNMLHWWFDQNKEKIEAYLK KHPDKQKIMFGDQELLDVRKVINTKGDQTNSELFNYFRDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRLNHV INLWGADFDSNGNLKAIYVTDSDSNASIGMKKYFVGVNSSGKVAISAKEIKEDNIGAQVLGLFTLSTGQDSWN QTN (SEQ ID NO: 337) |
| PRT-283 | MVTSVWTKGVTPPAKFTQGEDVFHAPYDANQGWYDITKTFNGKDDLLCGAATAGNMLHWWFDQNKEKIEAYLK KHPDKQKIMFGDQELLDVRKVINTKGDQTNSELFNYERDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRISHV INLWGADFDSNGNLKAIYVTDSDSNASIGMKKYFVGVNSAGKVAISAKEIKEDNIGAQVLGLFTLSTGQDSWN QTN (SEQ ID NO: 338) |
| PRT-284 | MVTSVWTKGVTPPAKFTQGEDVFHAPYVANQGWYDITKTFNGKDDLLCGAATAGNMLHWWFDQNKEKIEAYLK KHPDKQKIMFGDQELLDVRKVINTKGDQTNSELFNYFRDKAFPNLSARRIGVMPDLVLDMFINGYYLNVYKTQ TTDVNRTYQEKDRRGGIFDAVETRGDQSKLLTSRHDFKEKNLKEISDLIKKELTEGKALGLSHTYANVRLNHV INLWGADFDSNGNLKAIYVTDSDSNASIGMKKYGVGVNSAGKVAISAKEIKEDNIGAQVLGLFTLSTGQDSWN QTN (SEQ ID NO: 339) |
| PRT-285 | MVTSVWTKGVTPPAKFTQGEDVFHAPYDANQGWYDITKTFNGKDDLLCGAATAGNMLHWWFDQNKEKIEAYLK KHPDKQKIMFGDQELLDVRKVINTKGDQTNSELFNYFRDKAFPGLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRISHV INLWGADFDSNGNLKAIYVTDSDSNASIGMKKYGVGVNSAGKVAISAKEIKEDNIGAQVLGLFTLSTGQDSWN QTN (SEQ ID NO: 340) |
| PRT-286 | MVTSVWTKGVTPPAKFTQGEDVFHAPYDANQGWYDITKTFNGKDDLLCGAATAGNMLHWWFDQNKEKIEAYLK KHPDKQKIMFGDQELLDVRKVINTKGDQTNSELFNYERDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRISHV INLWGADFDSNGNLKAIYVTDSDSNASIGMKKYFVGVNSSGKVAISAKEIKEDNIGAQVLGLFTLSTGQDSWN QTN (SEQ ID NO: 341) |
| PRT-287 | MVTSVWTKGVTPPAKFTQGEDVFHAPYVANQGWYDITKEFNGKDDLLCGAATAGNMLHWWFDQNKEKIEAYLK KHPDKQKIMFGDQELLDVRKVINTKGDQTNSELFNYFRDKAFPNLSARRIGVMPDLVLDMFINGYYLNVYKTQ TTDVNRTYQEKDRRGGIFDAVFTRGDQSKLLTSRHDFKEKNLKEISDLIKKELTEGKALGLSHTYANVRIGHV INLWGADFDSNGNLKAIYVTDSDSNASIGMKKYGVGVNSAGKVAISAKEIKEDNIGAQVLGLFTLSTGQDSWN QTN (SEQ ID NO: 342) |
| PRT-288 | MVTSVWTKGVTPPAKFTQGEDVFHAPYDANQGWYDITKEFNGKDDLLCGAATAGNMLHWWFDQNKEKIEAYLK KHPDKQKIMFGDQELLDVRKVINTKGDQTNSELFNYERDKAFPNLSARRIGVMPDLVLDMFINGYYLNVYKTQ TTDVNRTYQEKDRRGGIFDAVETRGDQSKLLTSRHDFKEKNLKEISDLIKKELTEGKALGLSHTYANVRIGHV INLWGADFDSNGNLKAIYVTDSDSNASIGMKKYGVGVNSAGKVAISAKEIKEDNIGAQVLGLFTLSTGQDSWN QTN (SEQ ID NO: 343) |
| PRT-289 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDRGGIFDAVFTRGDQSKLLTSRHDFKEKGLKEISDLIKQELTEGKALGLSHTYANVGINHV INLWGADFDSDGNLKAIYVTDSDSNASIGMKKYFVGVNSSGKVAISAKEIKEDNIGAQVLGLFTLSTGQDIWN QTN (SEQ ID NO: 344) |

TABLE 5-continued

| ID | Polypeptide having protease activity Seq |
|---|---|
| PRT-290 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVETRGDQSKLLTSRHDFKEKGLKEISDLIKQELTEGKALGLSHTYANVRIGHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 345) |
| PRT-291 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRLNHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 346) |
| PRT-292 | MVTSVWTKGVTPPADFTQGEDVFHAPYDANQGWYDITKTFNGKDDLLCGAATAGNMLHWWFDQNKEYIEAYLK<br>KHPEKQKIMFGDQELLDVRKAINTKGSQKNSELFNYERDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRISHV<br>INLWGADFDSDGNLKAIYVTDSDSNASIGMKKYFVGVNSAGKVAISAKEIKEDNIGAQVLGLFTLSTGQDIWN<br>QTN (SEQ ID NO: 347) |
| PRT-293 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRLNHV<br>INLWGADFDSDGNLKAIYVTDSDSNASIGMKKYGVGVNSAGKVAISAKEIKEDNIGAQVLGLFTLSTGQDIWN<br>QTN (SEQ ID NO: 348) |
| PRT-294 | MVTSVWTKGVTPPADFTQGEDVFHAPYDANQGWYDITKTFNGKDDLLCGAATAGNMLHWWFDQNKEYIEAYLK<br>KHPEKQKIMFGDQELLDVRKAINTKGSQKNSELFNYERDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRISHV<br>INLWGADFDSDGNLKAIYVTDSDSNASIGMKKYGVGVNSAGKVAISAKEIKEDNIGAQVLGLFTLSTGQDIWN<br>QTN (SEQ ID NO: 349) |
| PRT-295 | MVTSVWTKGVTPPADFTQGEDVFHAPYDANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRISHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 350) |
| PRT-296 | MVTSVWTKGVTPPADFTQGEDVFHAPYVANQGWYDITKEFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRIGHV<br>INLWGADFDSDGNLKAIYVTDSDSNASIGMKKYGVGVNSAGKVAISAKEIKEDNIGAQVLGLFTLSTGQDIWN<br>QTN (SEQ ID NO: 351) |
| PRT-297 | MVTSVWTKGVTPPADFTQGEDVFHAPYDANQGWYDITKEFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRIGHV<br>INLWGADFDSDGNLKAIYVTDSDSNASIGMKKYGVGVNSAGKVAISAKEIKEDNIGAQVLGLFTLSTGQDIWN<br>QTN (SEQ ID NO: 352) |
| PRT-298 | MVTSVWTKGVTPPTDFIKGEDVFHAPYKAGQGWYDITKTFNGKDDLLCGAATAGNMLHWWFDQNKEYIEAYLK<br>KHPEKQKIMFGDQELLDVRKAINTKGSQKNSELFNYERDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVGINHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 353) |
| PRT-299 | MVTSVWTKGVTPPTDFIKGEDVFHAPYKAGQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRIGHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 354) |
| PRT-300 | MVTSVWTKGVTPPTDFIKGEDVFHAPYKAGQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRLNHV<br>INLWGADFDSDGNLKAIYVTDSDSNASIGMKKYFVGVNSSGKVAISAKEIKEDNIGAQVLGLFTLSTGQDIWN<br>QTN (SEQ ID NO: 355) |
| PRT-301 | MVTSVWTKGVTPPTDFIKGEDVFHAPYDAGQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRISHV<br>INLWGADFDSDGNLKAIYVTDSDSNASIGMKKYFVGVNSAGKVAISAKEIKEDNIGAQVLGLFTLSTGQDIWN<br>QTN (SEQ ID NO: 356) |
| PRT-302 | MVTSVWTKGVTPPTDFIKGEDVFHAPYKAGQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRLNHV<br>INLWGADFDSDGNLKAIYVTDSDSNASIGMKKYGVGVNSAGKVAISAKEIKEDNIGAQVLGLFTLSTGQDIWN<br>QTN (SEQ ID NO: 357) |

TABLE 5-continued

| ID | Polypeptide having protease activity Seq |
|---|---|
| PRT-303 | MVTSVWTKGVTPPTDFIKGEDVFHAPYDAGQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTYANVRISHV INLWGADFDSDGNLKAIYVTDSDSNASIGMKKYGVGVNSAGKVAISAKEIKEDNIGAQVLGLFTLSTGQDIWN QTN (SEQ ID NO: 358) |
| PRT-304 | MVTSVWTKGVTPPTDFIKGEDVFHAPYDAGQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTYANVRISHV INLWGADFDSDGNLKAIYVTDSDSNASIGMKKYFVGVNSSGKVAISAKEIKEDNIGAQVLGLFTLSTGQDIWN QTN (SEQ ID NO: 359) |
| PRT-305 | MVTSVWTKGVTPPTDFIKGEDVFHAPYKAGQGWYDITKEFNGKDDLLCGAATAGNMLHWWFDQNKEYIEAYLK KHPEKQKIMFGDQELLDVRKAINTKGSQKNSELFNYERDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTYANVRIGHV INLWGADFDSDGNLKAIYVTDSDSNASIGMKKYGVGVNSAGKVAISAKEIKEDNIGAQVLGLFTLSTGQDIWN QTN (SEQ ID NO: 360) |
| PRT-306 | MVTSVWTKGVTPPTDFIKGEDVFHAPYDAGQGWYDITKEFNGKDDLLCGAATAGNMLHWWFDQNKEYIEAYLK KHPEKQKIMFGDQELLDVRKAINTKGSQKNSELFNYERDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTYANVRIGHV INLWGADFDSDGNLKAIYVTDSDSNASIGMKKYGVGVNSAGKVAISAKEIKEDNIGAQVLGLFTLSTGQDIWN QTN (SEQ ID NO: 361) |
| PRT-307 | MQITSVWTKGVTPLTPEQFRKNNEDVIHAPYLAHQGWYDITKAFDGKDNLLCGAATAGNMLHWWFDQNKTEIE AYLSKHPEKQKIIFNNQELFDLKAAIDTKDSQTNSQLFNYFRDKAFPNLSARQLGVMPDLVLDMFINGYYLNV GKTQSTDVNRPYQDKDKRGGIFDAVFTRGDQTILLTARHDLKNKGLNDISTIIKQELTEGRALALSHTYANVS ISHVINLWGADFNAEGNLEAIYVTDSDANASIGMKKYFVGRNAHGHVAISAKKIEGENIGAQVLGLFTLSSGK DIWQKLS (SEQ ID NO: 362) |
| PRT-308 | MQITSVWTKGVTPLTPEQFRENNEDVIHAPYLAHQGWYDITKAFDGKDNLLCGAATAGNMLHWWFDQNKTEIE AYLSKHPEKQKIIFNNQELFDLKAAIDTKDSQTNSQLFNYFRDKAFPNLSARQLGVMPDLVLDMFINGYYLNV GKTQSTDVNRPYQDKDKRGGIFDAVFTRGDQTTLLTARHDLKNKGLNDISTIIKQELTEGRALALSHTYANVS ISHVINLWGADFDAEGNLEAIYVTDSDANASIGMKKYFVGRNAHGHVAISAKKIEGENIGAQVLGLFTLSLGK DIWQKLS (SEQ ID NO: 363) |
| PRT-309 | MQITSVWTKGVTPLTPEQFRENNEDVIHAPYLAHQGWYDITKAFDGKDNLLCGAATAGNMLHWWFDQNKTEIE AYLSKHPEKQKIIFGNQELFDLKAAIDTKDSQTNSQLFDYFRDKAFPNLSARQLGVMPDLVLDMFINGYYLNV GKTQSTDVNRPYQDKDKRGGIFDAVFTRGDQTTLLTARHDLKNKGLNDISTIIKQELTEGRALALSHTYANVS ISHVINLWGADFDAEGNLEAIYVTDSDANASIGMKKYFVGRNAHGHVAISAKKIEGENIGAQVLGLFTLSSGK DQWQKLS (SEQ ID NO: 364) |
| PRT-310 | MQITSVWTKGVTPLTPEQFRENNEDVIHAPYLAHQGWYDITKAFDGKDNLLCGAATAGNMLHWWFDQNKTEIE AYLSKHPEKQKIIFNNQELFDLKAAIDTKDSQTNSQLFDYFRDKAFPNLSARQLGVMPDLVLDMFINGYYLNV FKTQSTDVNRPYQDKDKRGGIFDAVETRGDQTTLLTARHDLKNKGLNDISTIIKQELTEGRALALSHTYANVS ISHVINLWGADFDAEGNLEAIYVTDSDANASIGMKKYFVGRNAHGHVAISAKKIEGENIGAQVLGLFTLSSGK DQWQKLS (SEQ ID NO: 365) |
| PRT-311 | MQITSVWTKGVTPLTPEQFRENNEDVIHAPYLAHQGWYDITKAFDGKDNLLCGAATAGNMLHWWFDQNKTEIE AYLSKHPEKQKIIFNNQEWFDLKAAIDTKDSQTNSQLFNYFRDKAFPNLSARQLGVMPDLVLDMFINGYYLNV PKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANASIGMKKYAVGINAHGHVAISAKKIEGENIGAQVLGLFTLSSGK DIWQKLS (SEQ ID NO: 366) |
| PRT-312 | MQITSVWTKGVTPLTPEQFRENNEDVIHAPYLAHQGWYDITKAFDGKDNLLCGAATAGNMLHWWFDQNKTEIE AYLSKHPEKQKIIFGNQELFDLKAAIDTKDSQTNSQLFNYFRDKAFPNLSARQLGVMPDLVLDMFINGYYLNV GKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANPSIGMKKYFVGRNAHGHVAISAKKIEGENIGAQVLGLFTLSSGK DIWQKLS (SEQ ID NO: 367) |
| PRT-313 | MQITSVWTKGVTPLTPEQFRENNEDVIHAPYLAHQGWYDITKAFDGKDNLLCGAATAGNMLHWWFDQNKTEIE AYLSKHPEKQKIIFGNQELFDLKAAIDTKDSQTNSQLFDYFRDKAFPNLSARQLGVMPDLVLDMFINGYYLNV GKTQSTDVNRPYQDKDKRGGIFDAVFTRGDQTTLLTARHDLKNKGLNDISTIIKQELTEGRALALSHTYANVS ISHVINLWGADFNAEGELEAIYVTDSDANPSIGMKKYFVGRNAHGHVAISAKKIEGENIGAQVLGLFTLSSGK DIWQKLS (SEQ ID NO: 368) |
| PRT-314 | MQITSVWTKGVTPLTPEQFRENNEDVIHAPYLAHQGWYDITKAFDGKDNLLCGAATAGNMLHWWFDQNKTEIE AYLSKHPEKQKIIFGNQELFDLKAAIDTKDSQTNSQLFDYERDKAFPNLSARQLGVMPDLVLDMFINGYYLNV GKTQSTDVNRPYQDKDKRGGIFDAVFTRGDQTTLLTARHDLKNKGLNDISTIIKQELTEGRALALSHTYANVS ISHVINLWGADFNAEGELEAIYVTDSDANPSIGMKKYFVGRNAHGHVAISAKKIEGENIGAQVLGLFTLSSGK DQWQKLS (SEQ ID NO: 369) |
| PRT-315 | MQITSVWTKGVTPLTPEQFRENNEDVIHAPYLAHQGWYDITKAFDGKDNLLCGAATAGNMLHWWFDQNKTEIE AYLSKHPEKQKIIFNNQELFDLKAAIDTKDSQTNSQLFDYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGELEAIYVTDSDANPSIGMKKYFVGRNAHGHVAISAKKIEGENIGAQVLGLFTLSSGK DIWQKLS (SEQ ID NO: 370) |

TABLE 5-continued

| ID | Polypeptide having protease activity Seq |
|---|---|
| PRT-316 | MTITSVWTKGVTPPTPEDFRKNNEDVLHAPYVANQGWYDITKTFDGKDNLLCGAATAGNMLHWWFDQNKEEIE
RYLKKHPEKQKIIFNNQELFDVKAAIDTKDSQTNSKLFNYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSTGQ
DIWQKLS (SEQ ID NO: 371) |
| PRT-317 | MTITSVWTKGVTPPTPEDFRENNEDVLHAPYVANQGWYDITKTFDGKDNLLCGAATAGNMLHWWFDQNKEEIE
RYLKKHPEKQKIIFNNQELFDVKAAIDTKDSQTNSKLENYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSLGQ
DIWQKLS (SEQ ID NO: 372) |
| PRT-318 | MTITSVWTKGVTPPTPEDFRYNNEDVLHAPYVANQGWYDITKTFDGKDNLLCGAATAGNMLHWWFDQNKEEIE
RYLKKHPEKQKIIFNNQEWFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGVNANGKVAISAKKIEGDNIGAQVLGLFTLSLGQ
DIWQKLS (SEQ ID NO: 373) |
| PRT-319 | MTITSVWTKGVTPPTPEDFRENNEDVLHAPYVANQGWYDITKTFDGKDNLLCGAATAGNMLHWWFDQNKEEIE
RYLKKHPEKQKIIFNNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSLGQ
DIWQKLS (SEQ ID NO: 374) |
| PRT-320 | MTITSVWTKGVTPPTPEDFRENNEDVLHAPYVANQGWYDITKTFDGKDNLLCGAATAGNMLHWWFDQNKEEIE
RYLKKHPEKQKIIFGNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSTGQ
DQWQKLS (SEQ ID NO: 375) |
| PRT-321 | MTITSVWTKGVTPPTPEDFRENNEDVLHAPYVANQGWYDITKTFDGKDNLLCGAATAGNMLHWWFDQNKEEIE
RYLKKHPEKQKIIFGNQELFDVKAAIDTKDSQTNSKLFDYFRDKAFPNLSARQLGVMPDLVLDMFINGYYLNL
PKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYAVGVNANGKVAISAKKIEGDNIGAQVLGLFTLSTGQ
DQWQKLS (SEQ ID NO: 376) |
| PRT-322 | MTITSVWTKGVTPPTPEDFRENNEDVLHAPYVANQGWYDITKTFDGKDNLLCGAATAGNMLHWWFDQNKEEIE
RYLKKHPEKQKIIFNNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSTGQ
DQWQKLS (SEQ ID NO: 377) |
| PRT-323 | MTITSVWTKGVTPPTPEDFRENNEDVLHAPYVANQGWYDITKTFDGKDNLLCGAATAGNMLHWWFDQNKEEIE
RYLKKHPEKQKIIFNNQEWFDVKAAIDTKDSQTNSKLFNYFRDKAFPNLSARQLGVMPDLVLDMFINGYYLNL
PKTQSTDVNRPYQDKDKRGGIFDAVFTRGDQTTLLTARHDLKNKGLNEISDLIKQELTEGKALALSHTYANVR
INHVINLWGADFDAEGNLIAIYVTDSDANASIGMKKYAVGVNANGKVAISAKKIEGDNIGAQVLGLFTLSTGQ
DIWQKLS (SEQ ID NO: 378) |
| PRT-324 | MTITSVWTKGVTPPTPEDFRENNEDVLHAPYVANQGWYDITKTFDGKDNLLCGAATAGNMLHWWFDQNKEEIE
RYLKKHPEKQKIIFGNQELFDVKAAIDTKDSQTNSKLFNYFRDKAFPNLSARQLGVMPDLVLDMFINGYYLNL
GKTQSTDVNRPYQDKDKRGGIFDAVETRGDQTTLLTARHDLKNKGLNEISDLIKQELTEGKALALSHTYANVR
INHVINLWGADFDAEGNLIAIYVTDSDANPSIGMKKYFVGRNANGKVAISAKKIEGDNIGAQVLGLFTLSTGQ
DIWQKLS (SEQ ID NO: 379) |
| PRT-325 | MTITSVWTKGVTPPTPEDFRENNEDVLHAPYVANQGWYDITKTFDGKDNLLCGAATAGNMLHWWFDQNKEEIE
RYLKKHPEKQKIIFGNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGELIAIYVTDSDANPSIGMKKYFVGRNANGKVAISAKKIEGDNIGAQVLGLFTLSTGQ
DIWQKLS (SEQ ID NO: 380) |
| PRT-326 | MTITSVWTKGVTPPTPEDFRENNEDVLHAPYVANQGWYDITKTFDGKDNLLCGAATAGNMLHWWFDQNKEEIE
RYLKKHPEKQKIIFGNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGELIAIYVTDSDANPSIGMKKYFVGRNANGKVAISAKKIEGDNIGAQVLGLFTLSTGQ
DQWQKLS (SEQ ID NO: 381) |
| PRT-327 | MTITSVWTKGVTPPTPEDFRENNEDVLHAPYVANQGWYDITKTFDGKDNLLCGAATAGNMLHWWFDQNKEEIE
RYLKKHPEKQKIIFNNQELFDVKAAIDTKDSQTNSKLFDYFRDKAFPNLSARQLGVMPDLVLDMFINGYYLNL
GKTQSTDVNRPYQDKDKRGGIFDAVFTRGDQTTLLTARHDLKNKGLNEISDLIKQELTEGKALALSHTYANVR
INHVINLWGADFDAEGELIAIYVTDSDANPSIGMKKYFVGRNANGKVAISAKKIEGDNIGAQVLGLFTLSTGQ
DIWQKLS (SEQ ID NO: 382) |
| PRT-328 | MTITSVWTKGVTPPTPEDFRKNNEDVLHAPYVANQGWYDITKTFDGKDNLLCGAATAGNMLHWWFDQNKEEIE
RYLKKHPEKQKIIFNNQELFDVKAAIDTKDSQTNSKLENYFRDKAFPGLSARQLGVFPDLVLDMFINGYYLNL
GKTQSTDVNRPYQDKDKRGGIFDAVFTRGVQTTLLTARHDLKNKGLNEISDLIKQELTEGKALALSHTYANVR
INHVINLWGADFDAEGNLIAIYVTDSDANASIGMKKYFVGRNANGKVAISAKKIEGDNIGAQVLGLFTLSTGQ
DIWQKLS (SEQ ID NO: 383) |

TABLE 5-continued

| ID | Polypeptide having protease activity Seq |
|---|---|
| PRT-329 | MTITSVWTKGVTPPTPEDFRENNEDVLHAPYVANQGWYDITKTFDGKDNLLCGAATAGNMLHWWFDQNKEEIE RYLKKHPEKQKIIFNNQELFDVKAAIDTKDSQTNSKLFNYFRDKAFPGLSARQLGVFPDLVLDMFINGYYLNL GKTQSTDVNRPYQDKDKRGGIFDAVFTRGVQTTLLTARHDLKNKGLNEISDLIKQELTEGKALALSHTYANVR INHVINLWGADFDAEGNLIAIYVTDSDANASIGMKKYFVGRNANGKVAISAKKIEGDNIGAQVLGLFTLSLGQ DIWQKLS (SEQ ID NO: 384) |
| PRT-330 | MTITSVWTKGVTPPTPEDFRENNEDVLHAPYVANQGWYDITKTFDGKDNLLCGAATAGNMLHWWFDQNKEEIE RYLKKHPEKQKIIFGNQELFDVKAAIDTKDSQTNSKLFDYFRDKAFPGLSARQLGVFPDLVLDMFINGYYLNL GKTQSTDVNRPYQDKDKRGGIFDAVFTRGVQTTLLTARHDLKNKGLNEISDLIKQELTEGKALALSHTYANVR INHVINLWGADFDAEGNLIAIYVTDSDANASIGMKKYFVGRNANGKVAISAKKIEGDNIGAQVLGLFTLSTGQ DQWQKLS (SEQ ID NO: 385) |
| PRT-331 | MTITSVWTKGVTPPTPEDFRENNEDVLHAPYVANQGWYDITKTFDGKDNLLCGAATAGNMLHWWFDQNKEEIE RYLKKHPEKQKIIFGNQELFDVKAAIDTKDSQTNSKLFDYFRDKAFPGLSARQLGVFPDLVLDMFINGYYLNL GKTQSTDVNRPYQDKDKRGGIFDAVETRGVQTTLLTARHDLKNKGLNEISDLIKQELTEGKALALSHTYANVR INHVINLWGADFDAEGNLIAIYVTDSDANASIGMKKYFVGRNANGKVAISAKKIEGDNIGAQVLGLFTLSTGQ DQWQKLS (SEQ ID NO: 386) |
| PRT-332 | MTITSVWTKGVTPPTPEDFRENNEDVLHAPYVANQGWYDITKTFDGKDNLLCGAATAGNMLHWWFDQNKEEIE RYLKKHPEKQKIIFNNQEWFDVKAAIDTKDSQTNSKLFNYFRDKAFPGLSARQLGVFPDLVLDMFINGYYLNL PKTQSTDVNRPYQDKDKRGGIFDAVFTRGVQTTLLTARHDLKNKGLNEISDLIKQELTEGKALALSHTYANVR INHVINLWGADFDAEGNLIAIYVTDSDANASIGMKKYFAVGVNANGKVAISAKKIEGDNIGAQVLGLFTLSTGQ DIWQKLS (SEQ ID NO: 387) |
| PRT-333 | MTITSVWTKGVTPPTPEDFRENNEDVLHAPYVANQGWYDITKTFDGKDNLLCGAATAGNMLHWWFDQNKEEIE RYLKKHPEKQKIIFGNQELFDVKAAIDTKDSQTNSKLFDYFRDKAFPGLSARQLGVFPDLVLDMFINGYYLNL GKTQSTDVNRPYQDKDKRGGIFDAVETRGVQTTLLTARHDLKNKGLNEISDLIKQELTEGKALALSHTYANVR INHVINLWGADFDAEGNLIAIYVTDSDANPSIGMKKYFVGRNANGKVAISAKKIEGDNIGAQVLGLFTLSTGQ DIWQKLS (SEQ ID NO: 388) |
| PRT-334 | MTITSVWTKGVTPPTPEDFRENNEDVLHAPYVANQGWYDITKTFDGKDNLLCGAATAGNMLHWWFDQNKEEIE RYLKKHPEKQKIIFGNQELFDVKAAIDTKDSQTNSKLFDYFRDKAFPGLSARQLGVFPDLVLDMFINGYYLNL GKTQSTDVNRPYQDKDKRGGIFDAVFTRGVQTTLLTARHDLKNKGLNEISDLIKQELTEGKALALSHTYANVR INHVINLWGADFDAEGELIAIYVTDSDANPSIGMKKYFVGRNANGKVAISAKKIEGDNIGAQVLGLFTLSTGQ DIWQKLS (SEQ ID NO: 389) |
| PRT-335 | MTITSVWTKGVTPPTPEDFRENNEDVLHAPYVANQGWYDITKTFDGKDNLLCGAATAGNMLHWWFDQNKEEIE RYLKKHPEKQKIIFGNQELFDVKAAIDTKDSQTNSKLEDYFRDKAFPGLSARQLGVFPDLVLDMFINGYYLNL GKTQSTDVNRPYQDKDKRGGIFDAVETRGVQTTLLTARHDLKNKGLNEISDLIKQELTEGKALALSHTYANVR INHVINLWGADFDAEGELIAIYVTDSDANPSIGMKKYFVGRNANGKVAISAKKIEGDNIGAQVLGLFTLSTGQ DQWQKLS (SEQ ID NO: 390) |
| PRT-336 | MTITSVWTKGVTPPTPEDFRENNEDVLHAPYVANQGWYDITKTFDGKDNLLCGAATAGNMLHWWFDQNKEEIE RYLKKHPEKQKIIFNNQELFDVKAAIDTKDSQTNSKLFDYFRDKAFPGLSARQLGVFPDLVLDMFINGYYLNL GKTQSTDVNRPYQDKDKRGGIFDAVFTRGVQTTLLTARHDLKNKGLNEISDLIKQELTEGKALALSHTYANVR INHVINLWGADFDAEGELIAIYVTDSDANPSIGMKKYFVGRNANGKVAISAKKIEGDNIGAQVLGLFTLSTGQ DIWQKLS (SEQ ID NO: 391) |
| PRT-337 | MTITSVWTKGVTPPTPEDERKNNEDVLHAPYLANQGWYDITKAFDGKDNLLCGAATAGNMLHWWFDQNKEEIE RYLKKHPEKQKIIFNNQELFDVKAAIDTKDSQTNSKLFNYFRDKAFPNLSARQLGVMPDLVLDMFINGYYLNL GKTQSTDVNRPYQDKDKRGGIFDAVFTRGDQTTLLTARHDLKNKGLNEISDLIKQELTEGKALALSHTYANVS INHVINLWGADFDAEGNLEAIYVTDSDANASIGMKKYFVGRNAHGKVAISAKKIEGDNIGAQVLGLFTLSTGQ DIWQKLS (SEQ ID NO: 392) |
| PRT-338 | MTITSVWTKGVTPPTPEDFRENNEDVLHAPYLANQGWYDITKAFDGKDNLLCGAATAGNMLHWWFDQNKEEIE RYLKKHPEKQKIIFNNQELFDVKAAIDTKDSQTNSKLFNYFRDKAFPNLSARQLGVMPDLVLDMFINGYYLNL GKTQSTDVNRPYQDKDKRGGIFDAVFTRGDQTTLLTARHDLKNKGLNEISDLIKQELTEGKALALSHTYANVS INHVINLWGADFDAEGNLEAIYVTDSDANASIGMKKYFVGRNAHGKVAISAKKIEGDNIGAQVLGLFTLSLGQ DIWQKLS (SEQ ID NO: 393) |
| PRT-339 | MTITSVWTKGVTPPTPEDFRENNEDVLHAPYLANQGWYDITKAFDGKDNLLCGAATAGNMLHWWFDQNKEEIE RYLKKHPEKQKIIFGNQELFDVKAAIDTKDSQTNSKLFDYFRDKAFPNLSARQLGVMPDLVLDMFINGYYLNL GKTQSTDVNRPYQDKDKRGGIFDAVETRGDQTTLLTARHDLKNKGLNEISDLIKQELTEGKALALSHTYANVS INHVINLWGADFDAEGNLEAIYVTDSDANASIGMKKYFVGRNAHGKVAISAKKIEGDNIGAQVLGLFTLSTGQ DQWQKLS (SEQ ID NO: 394) |
| PRT-340 | MTITSVWTKGVTPPTPEDFRENNEDVLHAPYLANQGWYDITKAFDGKDNLLCGAATAGNMLHWWFDQNKEEIE RYLKKHPEKQKIIFNNQELFDVKAAIDTKDSQTNSKLFNYFRDKAFPNLSARQLGVMPDLVLDMFINGYYLNL GKTQSTDVNRPYQDKDKRGGIFDAVETRGDQTTLLTARHDLKNKGLNEISDLIKQELTEGKALALSHTYANVS INHVINLWGADFDAEGNLEAIYVTDSDANASIGMKKYFVGRNAHGKVAISAKKIEGDNIGAQVLGLFTLSTGQ DQWQKLS (SEQ ID NO: 395) |
| PRT-341 | MTITSVWTKGVTPPTPEDFRENNEDVLHAPYLANQGWYDITKAFDGKDNLLCGAATAGNMLHWWFDQNKEEIE RYLKKHPEKQKIIFNNQEWFDVKAAIDTKDSQTNSKLFNYERDKAFPNLSARQLGVMPDLVLDMFINGYYLNL PKTQSTDVNRPYQDKDKRGGIFDAVFTRGDQTTLLTARHDLKNKGLNEISDLIKQELTEGKALALSHTYANVS INHVINLWGADFDAEGNLEAIYVTDSDANASIGMKKYFAVGVNAHGKVAISAKKIEGDNIGAQVLGLFTLSTGQ DIWQKLS (SEQ ID NO: 396) |

TABLE 5-continued

| ID | Polypeptide having protease activity Seq |
|---|---|
| PRT-342 | MTITSVWTKGVTPPTPEDFRENNEDVLHAPYLANQGWYDITKAFDGKDNLLCGAATAGNMLHWWFDQNKEEIE<br>RYLKKHPEKQKIIFGNQELFDVKAAIDTKDSQTNSKLFNYERDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVS<br>INHVINLWGADFDAEGNLEAIYVTDSDANPSIGMKKYFVGRNAHGKVAISAKKIEGDNIGAQVLGLFTLSTGQ<br>DIWQKLS (SEQ ID NO: 397) |
| PRT-343 | MTITSVWTKGVTPPTPEDFRENNEDVLHAPYLANQGWYDITKAFDGKDNLLCGAATAGNMLHWWFDQNKEEIE<br>RYLKKHPEKQKIIFGNQELFDVKAAIDTKDSQTNSKLFDYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVS<br>INHVINLWGADFDAEGELEAIYVTDSDANPSIGMKKYFVGRNAHGKVAISAKKIEGDNIGAQVLGLFTLSTGQ<br>DIWQKLS (SEQ ID NO: 398) |
| PRT-344 | MTITSVWTKGVTPPTPEDFRENNEDVLHAPYLANQGWYDITKAFDGKDNLLCGAATAGNMLHWWFDQNKEEIE<br>RYLKKHPEKQKIIFGNQELFDVKAAIDTKDSQTNSKLFDYFRDKAFPNLSARQLGVMPDLVLDMFINGYYLNL<br>GKTQSTDVNRPYQDKDKRGGIFDAVETRGDQTTLLTARHDLKNKGLNEISDLIKQELTEGKALALSHTYANVS<br>INHVINLWGADFDAEGELEAIYVTDSDANPSIGMKKYFVGRNAHGKVAISAKKIEGDNIGAQVLGLFTLSTGQ<br>DQWQKLS (SEQ ID NO: 399) |
| PRT-345 | MTITSVWTKGVTPPTPEDFRENNEDVLHAPYLANQGWYDITKAFDGKDNLLCGAATAGNMLHWWFDQNKEEIE<br>RYLKKHPEKQKIIFNNQELFDVKAAIDTKDSQTNSKLFDYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVS<br>INHVINLWGADFDAEGELEAIYVTDSDANPSIGMKKYFVGRNAHGKVAISAKKIEGDNIGAQVLGLFTLSTGQ<br>DIWQKLS (SEQ ID NO: 400) |
| PRT-346 | MSQTEDSESLQRLRDIEDFQAEKEMQNVVYTKWLDGVDVKDHDFRKIVDGNSAYYATPLLNGRGFYDINKDEN<br>RDSDKCAAAVAANMFHYWLDINRDNVDRFLRQNPEKHGIIELPDGQLKLSDFLNTYESDHGYRDKSKLEDFIS<br>NNFNGPVWTDKLLDNYINGYAYNYKYGRTIEDPTKNTSKINFFKEVENEKILINNHSIRNQNEFSVLLSEALY<br>TGKAIGLSYGPAGLRHSLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 401) |
| PRT-347 | MSQTEDSESLQRLRDIEDFQAEKEMQNVVYTKWLDGVDVKDHDERKIVDGNSAYYATPLLNGRGWYDINKDEN<br>RDSDKCAAAVAANMFHYWLDINRDNVDRFLRQNPEKHGIIELPDGQLKLSDFLNTYESDHGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 402) |
| PRT-348 | MSQTEDSESLQRLRDIEDFQAEKKDQNVVYTKWLDGVDVKDHDERKIVDGNIAYYATPLLNGRGWYDINKDEN<br>RDSDKCAAAVAANMFHYWLDINRDNVDRFLRQNPEKHGIIELPDGQLKLSDFLNTYESDHGYRDKSKLFDFIS<br>ENFNGPVWTDKLLDNYINGYAYNYKYGRTIEDPTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 403) |
| PRT-349 | MSQTEDSESLQRLRDIEDFQAEKKDQNVVYTKWLDGVDVKDHDFRKIVDGNIAYYATPLLNGRGLYDINKDEN<br>RDSDKCAAAVAANMFHYWLDINRDNVDRFLRQNPEKHGIIELPDGQLKLSDFLNTYESDHGYRDKSKLFDFIS<br>ENFNGPVWTDKLLDNYINGYAYNYKYGRTIEDPTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 404) |
| PRT-350 | MSQTEDSESLQRLRDIEDFQAEKKDQNVVYTKWLDGVDVKDHDFRKIVDGNSAYYATPLLNGRGWYDINKDEN<br>RDSDKCAAAVAANMFHYWLDINRDNVDRFLRQNPEKHGIIELPDGQLKLSDFLNTYESDHGYRDKSKLFDFIS<br>ENFNGPVWTDKLLDNYINGYAYNYKYGRTIEDPTKNTSKINFFKEVENEKILINNHSIRNQNEFSVLLIEALY<br>TGKAIGLSYGPAGLRHSLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 405) |
| PRT-351 | MSQTEDSESLQRLRDIEDFQAEKKMQNVVYTKWLDGVDVKDHDERKIVDGNSAYYATPLLNGRGFYDINKDEN<br>RDSDKCAAAVAANMFHYWLDINRDNVDRFLRQNPEKHGIIELPDGQLKLSDFLNTYESDHGYRDKSKLFDFIS<br>ENFNGPVWTDKLLDNYINGYAYNYKYGRTIEDPTKNTSKINFFKEVENEKILINNHSIRNQNEFSVLLIEALY<br>TGKAIGLSYGPAGLRHSLGHIISVWGADLDADGNVVAIYVTDSDDKKLTIGDERVGLKRYKISTDDENRLRLT<br>AYEETHNTGGQIRGLWILDTGKYAWADYFDKTEQTGTDQAEQ (SEQ ID NO: 406) |
| PRT-352 | MSQTEDSESLQRLRDIEDFQAEKKMQNVVYTKWLDGVDVKDHDERKIVDGNSAYYATPLLNGRGFYDINKDEN<br>RDSDKCAAAVAANMFHYWLDINRDNVDRFLRQNPEKHGIIELPDGQLKLSDFLNTYESDHGYRDKSKLEDFIS<br>ENFNGPVWTDKLLDNYINGYAYNSKYGRTIEDPTKNTSKINFFKEVENEKILINNHSIRNQNEFSVLLIEALY<br>TGKAIGLSYGPAGLRHGLGHIISVWGADLDADGNVVAIYVTDSDDKKLTIGDERVGLKRYKISTDDENRLRLT<br>AYEETHNTGGQIRGLWILDTGKYAWADYFDKTEQTGTDQAEQ (SEQ ID NO: 407) |
| PRT-353 | MSQTEDSESLQRLRDIEDFQAEKEMQNVVYTKWLDGVDVKDHDERKIVDGNSAYYATPLLNGRGWYDINKDEN<br>RDSDKCAAAVAANMFHYWLDINRDNVDRFLRQNPEKHGIIELPDGQLKLSDFLNTYESDHGYRDKSKLFDFIS<br>ENFNGPVWTDKLLDNYINGYAYNSKYGRTIEDPTKNTSKINFFKEVFNEKILINNHSIRNQNEFSVLLIEALY<br>TGKAIGLSYGPAGLRHGLGHIISVWGADLDADGNVVAIYVTDSDDKKLTIGDERVGLKRYKISTDDENRLRLT<br>AYEETHNTGGQVRGLWTLDTGKYAWADYFDKTEQTGTDQAEQ (SEQ ID NO: 408) |
| PRT-354 | MSQTEDSESLQRLRDIEDFQAEKKMQNVVYTKWLDGVDVKDHDERKIVDGNEAYYATPLLNGRGFYDINKDEN<br>RDSDKCAAAVAANMFHYWLDINRDNVDRFLRQNPEKHGIIELPDGQLKLSDFLNTYESDHGYRDKSKLEDFIS<br>ENFNGPVWTDKLLDNYINGYAYNYKYGRTIEDPTKNTSKINFFKEVENEKILINNHSIRNQNELSVLLSEALY<br>TGKAIGLSYGPAGLRHSLGHIISVWGADLDADGNVVAIYVTDSDDKKLTIGDERVGLKRYKISTDDENRLRLT<br>AYEETHNTGGQIRGLWILDTGKYAWADYFDKTEQTGTDQAEQ (SEQ ID NO: 409) |

TABLE 5-continued

| ID | Polypeptide having protease activity Seq |
|---|---|
| PRT-355 | MSQTEDSESLQRLRDIEDFQAEKKMQNVVYTKWLDGVDVKDHDERKIVDGNEAYYATPLLNGRGFYDINKDEN<br>RDSDKCAAAVAANMFHYWLDINRDNVDRFLRQNPEKHGIIELPDGQLKLSDFLNTYESDHGYRDKSKLEDFIS<br>ENFNGPVWTDKLLDNYINGYAYNYKYGRLIEDPTKNTSKINFFKEVFNEKILINNHSIRNQNELSVLLSEALY<br>TGKAIGLSYGPAGTRHSLGHIISVWGADLDADGNVVAIYVTDSDDKKLTIGDERVGLKRYKISTDDENRLRLT<br>AYEETHNTGGQIRGLWTLDTGKYAWADYFDKTEQTGTDQAEQ (SEQ ID NO: 410) |
| PRT-356 | MSQTEDSESLQRLRDIEDFQAEKEKQNVVYTKWLDGVDVKDHDFRKIVDGNSAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 411) |
| PRT-357 | MSQTEDSESLQRLRDIEDFQAEKEKQNVVYTKWLDGVDVKDHDFRKIVDGNSAYYATPLLNGRGWYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 412) |
| PRT-358 | MSQTEDSESLQRLRDIEDFQAEKKDQNVVYTKWLDGVDVKDHDERKIVDGNIAYYATPLLNGRGWYDINKDEN<br>RDSDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNYKYGRTIEDPTKNTSKINFFKEVENEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 413) |
| PRT-359 | MSQTEDSESLQRLRDIEDFQAEKKDQNVVYTKWLDGVDVKDHDFRKIVDGNIAYYATPLLNGRGLYDINKDEN<br>RDSDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDPTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 414) |
| PRT-360 | MSQTEDSESLQRLRDIEDFQAEKKDQNVVYTKWLDGVDVKDHDFRKIVDGNSAYYATPLLNGRGWYDINKDEN<br>RDSDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDPTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 415) |
| PRT-361 | MSQTEDSESLQRLRDIEDFQAEKKKQNVVYTKWLDGVDVKDHDERKIVDGNSAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDPTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 416) |
| PRT-362 | MSQTEDSESLQRLRDIEDFQAEKKKQNVVYTKWLDGVDVKDHDFRKIVDGNSAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNSKYGRTIEDPTKNTSKINFFKEVFNEKILINNHSIRNQNEFSVLLIEALY<br>TGKAIGLSYGPAGLRHGLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 417) |
| PRT-363 | MSQTEDSESLQRLRDIEDFQAEKEKQNVVYTKWLDGVDVKDHDFRKIVDGNSAYYATPLLNGRGWYDINKDEN<br>RDSDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNSKYGRTIEDPTKNTSKINFFKEVFNEKILTNNHSIRNQNEFSVLLIEALY<br>TGKAIGLSYGPAGLRHGLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 418) |
| PRT-364 | MSQTEDSESLQRLRDIEDFQAEKKKQNVVYTKWLDGVDVKDHDERKIVDGNEAYYATPLLNGRGFYDINKDEN<br>RDSDKCAAAVAANMFHYWLDRNRDNVDRELRQNPEKHGIIELPDGQLKLSDFLNTYESDDGYRDKSKLEDFIS<br>ENFNGPVWTDKLLDNYINGYAYNYKYGRTIEDPTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 419) |
| PRT-365 | MSQTEDSESLQRLRDIEDFQAEKKKQNVVYTKWLDGVDVKDHDERKIVDGNEAYYATPLLNGRGFYDINKDEN<br>RDSDKCAAAVAANMFHYWLDRNRDNVDRELRQNPEKHGIIELPDGQLKLSDFLNTYESDDGYRDKSKLEDFIS<br>ENFNGPVWTDKLLDNYINGYAYNYKYGRLIEDPTKNTSKINFFKEVENEKILINNHSIRNQNELSVLLSEALY<br>TGKAIGLSYGPAGTRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 420) |
| PRT-366 | MSQTEDSESLQRLRDIEDFQAEKEKQNVVYTKWLDGVDVKDHDFRKIVDGNSAYYATPLLNGRGFYDINKDEN<br>RDNDKCAAAVAANMFHYWLDRNRDNVDRELRQNPEKHGIIELPDGQLKLSDFLNTYESDDGYRDKSKLFDFIS<br>NNFNGPVWTDKLLDNYINGYAYNYKYGRTIEDSTKNTSKINFFKEVENEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 421) |
| PRT-367 | MSQTEDSESLQRLRDIEDFQAEKEKQNVVYTKWLDGVDVKDHDFRKIVDGNSAYYATPLLNGRGWYDINKDEN<br>RDNDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDSTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 422) |

TABLE 5-continued

| ID | Polypeptide having protease activity Seq |
|---|---|
| PRT-368 | MSQTEDSESLQRLRDIEDFQAEKKDQNVVYTKWLDGVDVKDHDFRKIVDGNIAYYATPLLNGRGWYDINKDEN<br>RDNDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDSTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 423) |
| PRT-369 | MSQTEDSESLQRLRDIEDFQAEKKDQNVVYTKWLDGVDVKDHDERKIVDGNIAYYATPLLNGRGLYDINKDEN<br>RDNDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDSTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 424) |
| PRT-370 | MSQTEDSESLQRLRDIEDFQAEKKDQNVVYTKWLDGVDVKDHDERKIVDGNSAYYATPLLNGRGWYDINKDEN<br>RDNDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRTIEDSTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 425) |
| PRT-371 | MSQTEDSESLQRLRDIEDFQAEKKKQNVVYTKWLDGVDVKDHDFRKIVDGNSAYYATPLLNGRGFYDINKDEN<br>RDNDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNYKYGRTIEDSTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 426) |
| PRT-372 | MSQTEDSESLQRLRDIEDFQAEKKKQNVVYTKWLDGVDVKDHDERKIVDGNSAYYATPLLNGRGFYDINKDEN<br>RDNDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNSKYGRTIEDSTKNTSKINFFKEVFNEKILTNNHSIRNQNEFSVLLIEALY<br>TGKAIGLSYGPAGLRHGLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 427) |
| PRT-373 | MSQTEDSESLQRLRDIEDFQAEKEKQNVVYTKWLDGVDVKDHDFRKIVDGNSAYYATPLLNGRGWYDINKDEN<br>RDNDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNSKYGRTIEDSTKNTSKINFFKEVFNEKILINNHSIRNQNEFSVLLIEALY<br>TGKAIGLSYGPAGLRHGLGHIISVWGADLDADGNVVAIYVTDSDDKKLTIGDERVGLKRYKISTDDEGRLRLT<br>AYEETHNTGGQVRGLWTLDTGKQAWADYFDKTEQTGTDQAEQ (SEQ ID NO: 428) |
| PRT-374 | MSQTEDSESLQRLRDIEDFQAEKKKQNVVYTKWLDGVDVKDHDERKIVDGNEAYYATPLLNGRGFYDINKDEN<br>RDNDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNYKYGRTIEDSTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 429) |
| PRT-375 | MSQTEDSESLQRLRDIEDFQAEKKKQNVVYTKWLDGVDVKDHDERKIVDGNEAYYATPLLNGRGFYDINKDEN<br>RDNDKCAAAVAANMFHYWLDRNRDNVDRFLRQNPEKHGIIELPDGQLKLSDFLNTYESDDGYRDKSKLFDFIS<br>ENFNGPVWTDKLLDNYINGYAYNYKYGRLIEDSTKNTSKINFFKEVFNEKILINNHSIRNQNELSVLLSEALY<br>TGKAIGLSYGPAGTRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 430) |
| PRT-376 | MVTSVWTKGVTPPTNFTYGEDVLHAPYVANQGWYDITKLFNGKDDLLCGAATAGNMLHWWFDQNKEQIENYLK<br>KHPEKQKINFNGEQMEDVKEAIDTKDSQLDSKLFEYFKEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>N (SEQ ID NO: 431) |
| PRT-377 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFLEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>N (SEQ ID NO: 432) |
| PRT-378 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFKEKAFPSLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>N (SEQ ID NO: 433) |
| PRT-379 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFKEKAFPYLSTKHLGVFPDHVIDMFINGYRLSLLNHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>N (SEQ ID NO: 434) |
| PRT-380 | MVTSVWTKGVTPPTNFTYGEDVLHAPYVANQGWYDITKTFNGKDDLLCGAATAGNMLHWWFDQNKEQIENYLK<br>KHPEKQKINFNGEQMFDVKEAIDTKDSQLDSKLFEYFKEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANARINHVIN<br>LWGADFDAEGNLEAIYVTDSDSNASIGMKKYFVGVNSNGKVAISAKEIEEDNIGAQVLGLFTLSTGQDIWNQT<br>N (SEQ ID NO: 435) |

TABLE 5-continued

| ID | Polypeptide having protease activity Seq |
|---|---|
| PRT-381 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNPSIGMKKYFVGVNSNGKVAISAKEIEEDNIGAQVLGLFTLSTGQDIWNQT
N (SEQ ID NO: 436) |
| PRT-382 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYVVGVNSNGKVAISAKEIEEDNIGAQVLGLFTLSTGQDIWNQT
N (SEQ ID NO: 437) |
| PRT-383 | MVTSVWTKGVTPPTNFTYGEDVLHAPYVANQGWYDITKTFNGKDDLLCGAATAGNMLHWWFDQNKEQIENYLK
KHPEKQKINFNGEQMEDVKEAIDTKDSQLDSKLFDYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 438) |
| PRT-384 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPNLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 439) |
| PRT-385 | MVTSVWTKGVTPPTNFTYGEDVLHAPYVANQGWYDITKTFNGKDDLLCGAATAGNMLHWWFDQNKEQIENYLK
KHPEKQKINFNGEQMEDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANGRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 440) |
| PRT-386 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLTNHG
PTPVKRGSKDPRGGIFDAVFTRGDQSKLLTNRHDFKEKTLKEISDLIKQELTEGKALGISHTYANVRINHVIN
LWGADFDAEGNLEAIAVTDSDSNASIGMKKYFVGVNSNGKVAISAKEIEEDNIGAQVLGLFTLSTGQDIWNQT
N (SEQ ID NO: 441) |
| PRT-387 | MVTSVWTKGVTPPTNFTYGEDVLHAPYVANQGWYDITKTFNGKDDLLCGAATAGNMLHWWFDQNKEQIENYLK
KHPEKQKINFNGEQMEDVKEAIDTKDSQLDSKLFEYFKEKAFPYLSTKHLGVFPDHVIDMFINGYRLSLTNHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSSGKVAISAKEIEEDNIGAQVLGLFTLSTGQDIWNQT
N (SEQ ID NO: 442) |
| PRT-388 | MVTSVWTKGVTPPTNFTYGEDVLHAPYVANQGWYDITKTFNGKDTLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 443) |
| PRT-389 | MVTSVWTKGVTPPTNFTYGEDVLHAPYVANQGWYDITKTFNGKDDLLCGAATAGNMLHWWFDQNKEQIENYLK
KHPEKQKINFKGEQMEDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 444) |
| PRT-390 | MVTSVWTKGVTPPTNFTYGEDVLHAPYVANQGWYDITKTFNGKDDLLCGAATAGNMLHWWFDQNKEQIENYLK
KHPEKQKINFNGEQLFDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 445) |
| PRT-391 | MVTSVWTKGVTPPTNFTYGEDVLHAPYVANQGWYDITKTFNGKDDLLCGAATAGNMLHWWFDQNKEQIENYLK
KHPEKQKINFNGEQMEDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 446) |
| PRT-392 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLINHG
PTPVKRGSKDPRGGIFDAVFTRGVQSKLLTNRHDFKEKTLKEISDLIKQELTEGKALGISHTYANVRINHVIN
LWGADFDAEGNLEAIYVTDSDSNASIGMKKYFVGVNSNGKVAISAKEIEEDNIGAQVLGLFTLSTGQDIWNQT
N (SEQ ID NO: 447) |
| PRT-393 | MVTSVWTKGVTPPTNFTYGEDVLHAPYVANQGWYDITKTFNGKDDLLCGAATAGNMLHWWFDQNKEQIENYLK
KHPEKQKINFNGEQMFDVKEAIDTKDSQLDSKLFEYFKEKAFPYLSTKHLGVFPDHVIDMFINGYRLSLINHG
PTPVKRGSKDPRGGIFDAVFTRGDQSKLLTNRHDFKEKTLKEISDLIKQELTEGKALGISHTYANVRINHVIN
LWGADFDAEGNLEAIYVTDSTNASIGMKKYFVGVNSNGKVAISAKEIEEDNIGAQVLGLFTLSTGQDIWNQT
N (SEQ ID NO: 448) |

TABLE 5-continued

| ID | Polypeptide having protease activity Seq |
|---|---|
| PRT-394 | MVTSVWTKGVTPPTNFTYGEDVLHAPYVANQGWYDITKTFNGKDDLLCGAATAGNMLHWWFDQNKEQIENYLK KHPEKQKINFNGEQMFDVKEAIDTKDSQLDSKLFEYFKEKAFPYLSTKHLGVFPDHVLDMFINGYRLSLINHG PTPVKRGSKDPRGGIFDAVFTRGDQSKLLTNRHDFKEKTLKEISDLIKQELTEGKALGISHTYANVRINHVIN LWGADFDAEGNLEAIYVTDSDSEASIGMKKYFVGVNSNGKVAISAKEIEEDNIGAQVLGLFTLSTGQDIWNQT N (SEQ ID NO: 449) |
| PRT-395 | MVTSVWTKGVTPPADFTQGEDVFHAPYVANQGWYDITKTFNGKDDLLCGAATAGNMLHWWFDQNKEYIEAYLK KHPEKQKIMFGDQQLLDVRKAINTKGSQKNSELFNYFRDKAFPTLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYFVGVNSAGKVAISAKEIKEDNIGAQVLGLFTLSTGQDIWN QTN (SEQ ID NO: 450) |
| PRT-396 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYFVGVNSAGKVAISAKEIKEDNIGAQVLGLFTLSTGQDIWN QTN (SEQ ID NO: 451) |
| PRT-397 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVGINHV INLWGADFDSDGNLKAIYVTDSDSNASIGMKKYFVGVNSAGKVAISAKEIKEDNIGAQVLGLFTLSTGQDIWN QTN (SEQ ID NO: 452) |
| PRT-398 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYDVGVNSAGKVAISAKEIKEDNIGAQVLGLFTLSTGQDIWN QTN (SEQ ID NO: 453) |
| PRT-399 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYVVGVNSAGKVAISAKEIKEDNIGAQVLGLFTLSTGQDIWN QTN (SEQ ID NO: 454) |
| PRT-400 | MVTSVWTKGVTPPADFTQGEDVFHAPYDANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYFVGVNSAGKVAISAKEIKEDNIGAQVLGLFTLSTGQDIWN QTN (SEQ ID NO: 455) |
| PRT-401 | MVTSVWTKGVTPPADFTQGEDVFHAPYVANQGWYDITKEFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYFVGVNSAGKVAISAKEIKEDNIGAQVLGLFTLSTGQDIWN QTN (SEQ ID NO: 456) |
| PRT-402 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRLNHV INLWGADFDSDGNLKAIYVTDSDSNASIGMKKYFVGVNSAGKVAISAKEIKEDNIGAQVLGLFTLSTGQDIWN QTN (SEQ ID NO: 457) |
| PRT-403 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRISHV INLWGADFDSDGNLKAIYVTDSDSNASIGMKKYFVGVNSAGKVAISAKEIKEDNIGAQVLGLFTLSTGQDIWN QTN (SEQ ID NO: 458) |
| PRT-404 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRIGHV INLWGADFDSDGNLKAIYVTDSDSNASIGMKKYFVGVNSAGKVAISAKEIKEDNIGAQVLGLFTLSTGQDIWN QTN (SEQ ID NO: 459) |
| PRT-405 | MVTSVWTKGVTPPADFTQGEDVFHAPYVANQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTTYANVRINHV INLWGADFDSDGNLKAIYVTDSDSNASIGMKKYGVGVNSAGKVAISAKEIKEDNIGAQVLGLFTLSTGQDIWN QTN (SEQ ID NO: 460) |
| PRT-406 | MVTSVWTKGVTPPADFTQGEDVFHAPYVANQGWYDITKTFNRKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVETRGDQSKLLTSRHDFKEKGLKEISDLIKQELTEGKALGLSHTTYANVRINHV INLWGADFDSDGNLKAIYVTDSDSNASIGMKKYFVGVNSAGKVAISAKEIKEDNIGAQVLGLFTLSTGQDIWN QTN (SEQ ID NO: 461) |

TABLE 5-continued

| ID | Polypeptide having protease activity Seq |
|---|---|
| PRT-407 | MVTSVWTKGVTPPADFTQGEDVFHAPYVANQGWYDITKTFNGKDDLLCGAATAGNMLHWWFDQNKEYIEAYLK<br>KHPEKQKIIFGDQELLDVRKAINTKGSQKNSELFNYFRDKAFPNLSARRLGVMPDLVLDMFINGYYLNVTKTQ<br>TTDVNRTYQEKDKRGGIFDAVETRGDQSKLLTSRHDFKEKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQDIWN<br>QTN (SEQ ID NO: 462) |
| PRT-408 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVFPDLVLDMFINGYYLNVTKTQ<br>TTDVNRTYQEKDKRGGIFDAVFTRGDQSKLLTSRHDFKEKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQDIWN<br>QTN (SEQ ID NO: 463) |
| PRT-409 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVETRGVQSKLLTSRHDFKEKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQDIWN<br>QTN (SEQ ID NO: 464) |
| PRT-410 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRINHV<br>INLWGADFDSDGNLKAIYVTDSDTNASIGMKKYFVGVNSAGKVAISAKEIKEDNIGAQVLGLFTLSTGQDIWN<br>QTN (SEQ ID NO: 465) |
| PRT-411 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRINHV<br>INLWGADFDSDGNLKAIYVTDSDSRASIGMKKYFVGVNSAGKVAISAKEIKEDNIGAQVLGLFTLSTGQDIWN<br>QTN (SEQ ID NO: 466) |
| PRT-412 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDFKEKGLKEISDLIKQELTEGKALGLSHTYANVRINHV<br>INLWGADFDSDGNLKAIYVTDSDSNASIGMKKYFVGVNAAGKVAISAKEIKEDNIGAQVLGLFTLSTGQDIWN<br>QTN (SEQ ID NO: 467) |
| PRT-413 | MTITSVWTKGVTPPTPEDFRENNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYERDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 468) |
| PRT-414 | MTITSVWTKGVTPPTPEDFRYNNEDVLHAPYVANQGWYDITKTFDGKDNLLCGAATAGNMLHWWFDQNKEEIE<br>RYLKKHPEKQKIIFGNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 469) |
| PRT-415 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFLDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 470) |
| PRT-416 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>PKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 471) |
| PRT-417 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVETRGDQTTLLLTARHDLKNKGLNEISDLIKQELTEGKALALSHTYANVR<br>INHVINLWGADFDAEGELIAIYVTDSDANASIGMKKYFVGVNANGKVAISAKKIEGDNIGAQVLGLFTLSTGQ<br>DIWQKLS (SEQ ID NO: 472) |
| PRT-418 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYAVGVNANGKVAISAKKIEGDNIGAQVLGLFTLSTGQ<br>DIWQKLS (SEQ ID NO: 473) |
| PRT-419 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DQWQKLS (SEQ ID NO: 474) |

TABLE 5-continued

| ID | Polypeptide having protease activity Seq |
|---|---|
| PRT-420 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQEWFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 475) |
| PRT-421 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFDYFRDKAFPNLSARQLGVMPDLVLDMFINGYYLNL<br>GKTQSTDVNRPYQDKDKRGGIFDAVFTRGDQTTLLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 476) |
| PRT-422 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANPSIGMKKYFVGVNANGKVAISAKKIEGDNIGAQVLGLFTLSTGQ<br>DIWQKLS (SEQ ID NO: 477) |
| PRT-423 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANASIGMKKYFVGRNANGKVAISAKKIEGDNIGAQVLGLFTLSTGQ<br>DIWQKLS (SEQ ID NO: 478) |
| PRT-424 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSLGQ<br>DIWQKLS (SEQ ID NO: 479) |
| PRT-425 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPGLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 480) |
| PRT-426 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYERDKAFPNLSARQLGVFPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 481) |
| PRT-427 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGVQTTLLTARHDLKNKGLNEISDLIKQELTEGKALALSHTYANVR<br>INHVINLWGADFDAEGNLIAIYVTDSDANASIGMKKYFVGVNANGKVAISAKKIEGDNIGAQVLGLFTLSTGQ<br>DIWQKLS (SEQ ID NO: 482) |
| PRT-428 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDTNASIGMKKYFVGVNANGKVAISAKKIEGDNIGAQVLGLFTLSTGQ<br>DIWQKLS (SEQ ID NO: 483) |
| PRT-429 | MTITSVWTKGVTPPTPEDFRYNNEDVLHAPYVANQGWYDITKTFDGKDNLLCGAATAGNMLHWWFDQNKEEIE<br>RYLKKHPEKQKIIFNNQELFDVKAAIDTKDSQTNSKLFNYFRDKAFPNLSARQLGVMPDLVLDMFINGYYLNL<br>GKTQSTDVNRPYQDKDKRGGIFDAVFTRGDQTTLLTARHDLKNKGLNEISDLIKQELTEGKALALSHTYANVR<br>INHVINLWGADFDAEGNLIAIYVTDSDARASIGMKKYFVGVNANGKVAISAKKIEGDNIGAQVLGLFTLSTGQ<br>DIWQKLS (SEQ ID NO: 484) |
| PRT-430 | MSQTEDSESLQRLRDIEDFQAEKKKQNVVYTKWLDGVDVKDHDFRKIVDGNSAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILTNNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 485) |
| PRT-431 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>ENFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 486) |
| PRT-432 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNSKYGRTIEDPTKNTSKINFFKEVENEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 487) |

TABLE 5-continued

| ID | Polypeptide having protease activity Seq |
|---|---|
| PRT-433 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLIEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 488) |
| PRT-434 | MSQTEDSESLQRLRDIEDFQAEKKKQNVVYTKWLDGVDVKDHDERKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHGLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 489) |
| PRT-435 | MSQTEDSESLQRLRDIEDFQAEKEKQNVVYTKWLDGVDVKDHDERKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 490) |
| PRT-436 | MSQTEDSESLQRLRDIEDFQAEKKDQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 491) |
| PRT-437 | MSQTEDSESLQRLRDIEDFQAEKKKQNVVYTKWLDGVDVKDHDERKIVDGNEAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 492) |
| PRT-438 | MSQTEDSESLQRLRDIEDFQAEKKKQNVVYTKWLDGVDVKDHDERKIVDGNIAYYATPLLNGRGLYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 493) |
| PRT-439 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRLIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 494) |
| PRT-440 | MSQTEDSESLQRLRDIEDFQAEKKKQNVVYTKWLDGVDVKDHDERKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDPTKNTSKINFFKEVFNEKILINNHSIRNQNELSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 495) |
| PRT-441 | MSQTEDSESLQRLRDIEDFQAEKKKQNVVYTKWLDGVDVKDHDERKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGTRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 496) |
| PRT-442 | MSQTEDSESLQRLRDIEDFQAEKKKQNVVYTKWLDGVDVKDHDERKIVDGNIAYYATPLLNGRGFYDINKDEN<br>RDNDKCAAAVAANMFHYWLDRNRDNVDRFLRQNPEKHGIIELPDGQLKLSDFLNTYESDDGYRDKSKLFDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 497) |
| PRT-443 | MSQTEDSESLQRLRDIEDFQAEKKKQNVVYTKWLDGVDVKDHDERKIVDGNIAYYATPLLNGRGFYDINKDEN<br>RDSDKCAAAVAANMFHYWLDRNRDNVDRFLRQNPEKHGIIELPDEQLKLSDFLNTYESDDGYRDKSKLEDFIS<br>NNFNGPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWILDTGKQAWADYFDKTEQTGTDQAEQ (SEQ ID NO: 498) |
| PRT-444 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLFDFIS<br>NNFNKPVWTDKLLDNYINGYAYNYKYGRTIEDPTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 499) |
| PRT-445 | MSQTEDSESLQRLRDIEDFQAEKKKQNVVYTKWLDGVDVKDHDFRKIVDGNIAYYATPLLNGRGFYDINKDEN<br>RDSDKCAAAVAANMFHYWLDRNRDNVDRFLRQNPEKHGIIELPDGQLKLSDFLNTYESDDGYRDKSKLEDFIS<br>NNFNGPVWTDKLLDNYINGYAYNYKYGRTIEDSTKNTSKINFFKEVFNEKILINNHSIRNQNEFSVLLSEALY<br>TGKAIGLSYGPAGLRHSLGHIISVWGADLDADGNVVAIYVTDSDDKKLTIGDERVGLKRYKISTDDEGRLRLT<br>AYEETHNTGGQIRGLWTLDTGKQAWADYFDKTEQTGTDQAEQ (SEQ ID NO: 500) |

TABLE 5-continued

| ID | Polypeptide having protease activity Seq |
|---|---|
| PRT-446 | MVTSVWTKGVTPPTDFIKGEDVFHAPYKAGQGWYDITKTFNGKDDLLCGAATAGNMLHWWFDQNKDQIEAYLK EHPEKQKINFNGEQMFDVKEAIDTKDDQTNSKLFEYFKEKAFPYLSTKHLGVFPDHVLDMFINGYRLSLINHG PTPVKEGSKDPRGGIFDAVETRGDQSKLLTSRHDFKEKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQDIWNQT NLEHHHHHH (SEQ ID NO: 501) |
| PRT-447 | MVTSVWTKGVTPPTDFIKGEDVFHAPYKAGQGWYDITKAFDGGDDLLCGAATAGNMLHWWFDQNKDQIEAYLK EHPEKQKINFNGEQMEDVKEAIDTKDDQTNSELFNYFKEKAFPYLSTKHLGVFPDHVLDMFINGYRLSLTNHG PTPVKEGSKDPRGGIFDAVFTRGDQSKLLTSRHDFKEKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQDIWNQT NLEHHHHHH (SEQ ID NO: 502) |
| PRT-448 | MVTSVWTKGVTPPTDFIKGEDVFHAPYKAGQGWYDITKTFNGKDDLLCGAATAGNMLHWWFDQNKDQIEAYLK EHPEKQKINFNGEQMFDVKEAIDTKDDQTNSKLFEYFKEKAFPYLSTKHLGVFPDHVLDMFINGYRLSLINHG PTPVKEGSKDPRGGIFDAVFTRGDQSKLLTSRHDLKNKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQDIWNQT NLEHHHHHH (SEQ ID NO: 503) |
| PRT-449 | MVTSVWTKGVTPPTDFRKIVDGNIAYYHAPYKAGQGWYDITKTFNGKDDLLCGAATAGNMLHWWFDQNKDQIE AYLKEHPEKQKINFNGEQMFDVKEAIDTKDDQTNSKLFEYFKEKAFPYLSTKHLGVFPDHVLDMFINGYRLSL TNHGPTPVKEGSKDPRGGIFDAVETRGDQSKLLTSRHDFKEKTLKEISDLIKQELTEGKALALSHTYANVRIN HVINLWGADFDSNGNLEAIYVTDSDSNASIGMKKYFVGVNSAGKVAISAKEIEDDNIGAQVLGLFTLSTGQDI WNQTNLEHHHHHH (SEQ ID NO: 504) |
| PRT-450 | MVTSVWTKGVTPPTDERKIVDGNIAYYHAPYKAGQGWYDITKAFDGGDDLLCGAATAGNMLHWWFDQNKDQIE AYLKEHPEKQKINFNGEQMFDVKEAIDTKDDQTNSELFNYFKEKAFPYLSTKHLGVFPDHVLDMFINGYRLSL TNHGPTPVKEGSKDPRGGIFDAVFTRGDQSKLLTSRHDLKNKTLKEISDLIKQELTEGKALALSHTYANVRIN HVINLWGADFDSNGNLEAIYVTDSDSNASIGMKKYFVGVNSAGKVAISAKEIEDDNIGAQVLGLFTLSTGQDI WNQTNLEHHHHHH (SEQ ID NO: 505) |
| PRT-451 | MVTSVWTKGVTPPANFRKIVDGNIAYYHAPYKANQGWYDITKTFNGKDDLLCGAATAGNMLHWWFDQNKDQIE AYLKEHPEKQKINFNGEQMFDVKEAIDTKDDQTNSKLFEYFKEKAFPYLSTKHLGVFPDHVLDMFINGYRLSL TNHGPTPVKEGSKDPRGGIFDAVFTRGDQSKLLTSRHDLKNKTLKEISDLIKQELTEGKALALSHTYANVRIN HVINLWGADFDSNGNLEAIYVTDSDSNASIGMKKYFVGVNSAGKVAISAKEIEDDNIGAQVLGLFTLSTGQDI WNQTNLEHHHHHH (SEQ ID NO: 506) |
| PRT-452 | MVTSVWTKGVTPPANFTQGEDVFHAPYKANQGWYDITKAFDGGDDLLCGAATAGNMLHWWFDQNKDQIEAYLK EHPEKQKINFNGEQMEDVKEAIDTKDDQTNSELFNYFKEKAFPYLSTKHLGVFPDHVLDMFINGYRLSLINHG PTPVKEGSKDPRGGIFDAVFTRGDQSKLLTSRHDLKNKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQDIWNQT NLEHHHHHH (SEQ ID NO: 507) |
| PRT-453 | MVTSVWTKGVTPPANFTQGEDVFHAPYKANQGWYDITKTFNGKDDLLCGAATAGNMLHWWFDQNKDQIEAYLK EHPEKQKINFNGEQMEDVKEAIDTKDDQTNSKLFEYFKEKAFPYLSTKHLGVFPDHVLDMFINGYRLSLTNHG PTPVKEGSKDPRGGIFDAVFTRGDQSKLLTSRHDLKNKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQDIWNQT NLEHHHHHH (SEQ ID NO: 508) |
| PRT-454 | MITSVWTKGVTPPTDFIKGEDVFHAPYKAGQGWYDITKAFDGGDDLLCGAATAGNMLHWWFDQNKDQIEAYLK EHPEKQKINFNGEQMFDVKEAIDTKDDQTNSELFNYFKEKAFPYLSTKHLGVFPDHVLDMFINGYRLSLINHG PTPVKRQEKDPRGGIFDAVFGRGDQTKLLTSRHDFKEKTLNEISQLIKQELTEGKALALSHTYANVRINHVIN LWGADFDAEGNLEAIYVTDSDSNASIGMKKYFVGVNSAGKVAISAKEIEDDNIGAQVLGLFTLSTGQKIWNKT NLEHHHHHH (SEQ ID NO: 509) |
| PRT-455 | MITSVWTKGVTPPTDFIKGEDVFHAPYKAGQGWYDITKAFDGGDDLLCGAATAGNMLHWWFDQNKDQIEAYLK EHPEKQKINFNGEQMFDVKEAIDTKDDQTNSELFNYFKEKAFPYLSTKHLGVFPDHVLDMFINGYRLSLINHG PTPVKRQEKDPRGGIFDAVFGRGDQTKLLTSRHDLKNKTLNEISQLIKQELTEGKALALSHTYANVRINHVIN LWGADFDAEGNLEAIYVTDSDSNASIGMKKYFVGVNSAGKVAISAKEIEDDNIGAQVLGLFTLSTGQKIWNKT NLEHHHHHH (SEQ ID NO: 510) |
| PRT-456 | MITSVWTKGVTPPTDFIKGEDVFHAPYKAGQGWYDITKAFDGGDDLLCGAATAGNMLHWWFDQNKDQIEAYLK EHPEKQKINFNGEQMFDVKEAIDTKDDQTNSELFNYFKEKAFPYLSTKHLGVFPDHVLDMFINGYRLSLINHG PTPVKEGSKDPRGGIFDAVFTRGDQSKLLTSRHDLKNKTLNEISQLIKQELTEGKALALSHTYANVRINHVIN LWGADFDAEGNLEAIYVTDSDSNASIGMKKYFVGVNSAGKVAISAKEIEDDNIGAQVLGLFTLSTGQDIWNQT NLEHHHHHH (SEQ ID NO: 511) |
| PRT-457 | MVTSVWTKGVTPPTDFIKGEDVFHAPYKAGQGWYDITKAFDGGDDLLCGAATAGNMLHWWFDQNKDQIEAYLK EHPEKQKINFNGEQMFDVKEAIDTKDDQTNSELFNYFKEKAFPYLSTKHLGVFPDHVLDMFINGYRLSLINHG PTPVKRQEKDPRGGIFDAVEGRGDQTKLLTSRHDLKNKTLKEISDLIKQELTEGKALALSHTYANVRINHVIN LWGADFDSNGNLEAIYVTDSDSNASIGMKKYFVGVNSAGKVAISAKEIEDDNIGAQVLGLFTLSTGQKIWNKT NLEHHHHHH (SEQ ID NO: 512) |
| PRT-458 | MVTSVWTKGVTPPTDFIKGEDVFHAPYKAGQGWYDITKTFNGKDDLLCGAATAGNMLHWWFDQNKDQIERYLK EHPEKQKINFNGEQMFDVKEAIDTKDSQTDSKLFEYFKEKAFPYLSTKHLGVFPDHVLDMFINGYRLSLINHG PTPVKEGSKDPRGGIFDAVFTRGDQSKLLTSRHDFKEKTLKEISDLIKQELTEGKALGLSHTYANVRINHVIN LWGADFDSEGNLKAIYVTDSDSNASIGMKKYFVGVNSAGKVAISAKEIKEDNIGAQVLGLFTLSTGQDIWNQT NLEHHHHHH (SEQ ID NO: 513) |

TABLE 5-continued

| ID | Polypeptide having protease activity Seq |
|---|---|
| PRT-459 | MVTSVWTKGVTPPTDFIKGEDVFHAPYKAGQGWYDITKAFDGGDDLLCGAATAGNMLHWWFDQNKDQIERYLK<br>EHPEKQKINFNGEQMFDVKEAIDTKDSQTNSELFNYFKEKAFPYLSTKHLGVFPDHVLDMFINGYRLSLINHG<br>PTPVKEGSKDPRGGIFDAVETRGDQSKLLTSRHDFKEKTLKEISDLIKQELTEGKALGLSHTYANVRINHVIN<br>LWGADFDSEGNLKAIYVTDSDSNASIGMKKYFVGVNSAGKVAISAKEIKEDNIGAQVLGLFTLSTGQDIWNQT<br>NLEHHHHHH (SEQ ID NO: 514) |
| PRT-460 | MVTSVWTKGVTPPTDFIKGEDVFHAPYKAGQGWYDITKTFNGKDDLLCGAATAGNMLHWWFDQNKDQIERYLK<br>EHPEKQKINFNGEQMEDVKEAIDTKDSQTDSKLFEYFKEKAFPYLSTKHLGVFPDHVLDMFINGYRLSLINHG<br>PTPVKEGSKDPRGGIFDAVFTRGDQSKLLTSRHDLKNKTLKEISDLIKQELTEGKALGLSHTYANVRINHVIN<br>LWGADFDSEGNLKAIYVTDSDSNASIGMKKYFVGVNSAGKVAISAKEIKEDNIGAQVLGLFTLSTGQDIWNQT<br>NLEHHHHHH (SEQ ID NO: 515) |
| PRT-461 | MVTSVWTKGVTPPTDFRKIVDGNIAYYHAPYKAGQGWYDITKTENGKDDLLCGAATAGNMLHWWFDQNKDQIE<br>RYLKEHPEKQKINFNGEQMFDVKEAIDTKDSQTDSKLFEYFKEKAFPYLSTKHLGVFPDHVLDMFINGYRLSL<br>TNHGPTPVKEGSKDPRGGIFDAVETRGDQSKLLTSRHDFKEKTLKEISDLIKQELTEGKALGLSHTYANVRIN<br>HVINLWGADFDSEGNLKAIYVTDSDSNASIGMKKYFVGVNSAGKVAISAKEIKEDNIGAQVLGLFTLSTGQDI<br>WNQTNLEHHHHHH (SEQ ID NO: 516) |
| PRT-462 | MVTSVWTKGVTPPTDERKIVDGNIAYYHAPYKAGQGWYDITKAFDGGDDLLCGAATAGNMLHWWFDQNKDQIE<br>RYLKEHPEKQKINFNGEQMFDVKEAIDTKDSQTNSELFNYFKEKAFPYLSTKHLGVFPDHVLDMFINGYRLSL<br>TNHGPTPVKEGSKDPRGGIFDAVFTRGDQSKLLTSRHDLKNKTLKEISDLIKQELTEGKALGLSHTYANVRIN<br>HVINLWGADEDSEGNLKAIYVTDSDSNASIGMKKYFVGVNSAGKVAISAKEIKEDNIGAQVLGLFTLSTGQDI<br>WNQTNLEHHHHHH (SEQ ID NO: 517) |
| PRT-463 | MVTSVWTKGVTPPANFRKIVDGNIAYYHAPYVANQGWYDITKTFNGKDDLLCGAATAGNMLHWWFDQNKDQIE<br>RYLKEHPEKQKINFNGEQMEDVKEAIDTKDSQTDSKLFEYFKEKAFPYLSTKHLGVFPDHVLDMFINGYRLSL<br>TNHGPTPVKEGSKDPRGGIFDAVFTRGDQSKLLTSRHDLKNKTLKEISDLIKQELTEGKALGLSHTYANVRIN<br>HVINLWGADFDSEGNLKAIYVTDSDSNASIGMKKYFVGVNSAGKVAISAKEIKEDNIGAQVLGLFTLSTGQDI<br>WNQTNLEHHHHHH (SEQ ID NO: 518) |
| PRT-464 | MVTSVWTKGVTPPANFTQGEDVFHAPYVANQGWYDITKAFDGGDDLLCGAATAGNMLHWWFDQNKDQIERYLK<br>EHPEKQKINFNGEQMFDVKEAIDTKDSQTNSELFNYFKEKAFPYLSTKHLGVFPDHVLDMFINGYRLSLINHG<br>PTPVKEGSKDPRGGIFDAVFTRGDQSKLLTSRHDLKNKTLKEISDLIKQELTEGKALGLSHTYANVRINHVIN<br>LWGADFDSEGNLKAIYVTDSDSNASIGMKKYFVGVNSAGKVAISAKEIKEDNIGAQVLGLFTLSTGQDIWNQT<br>NLEHHHHHH (SEQ ID NO: 519) |
| PRT-465 | MVTSVWTKGVTPPANFTQGEDVFHAPYVANQGWYDITKTFNGKDDLLCGAATAGNMLHWWFDQNKDQIERYLK<br>EHPEKQKINFNGEQMFDVKEAIDTKDSQTDSKLFEYFKEKAFPYLSTKHLGVFPDHVLDMFINGYRLSLINHG<br>PTPVKEGSKDPRGGIFDAVETRGDQSKLLTSRHDLKNKTLKEISDLIKQELTEGKALGLSHTYANVRINHVIN<br>LWGADFDSEGNLKAIYVTDSDSNASIGMKKYFVGVNSAGKVAISAKEIKEDNIGAQVLGLFTLSTGQDIWNQT<br>NLEHHHHHH (SEQ ID NO: 520) |
| PRT-466 | MITSVWTKGVTPPTDFIKGEDVFHAPYKAGQGWYDITKAFDGGDDLLCGAATAGNMLHWWFDQNKDQIERYLK<br>EHPEKQKINFNGEQMFDVKEAIDTKDSQTNSELFNYFKEKAFPYLSTKHLGVFPDHVLDMFINGYRLSLINHG<br>PTPVKRQEKDPRGGIFDAVFGRGDQTKLLTSRHDFKEKTLNEISQLIKQELTEGKALGLSHTYANVRINHVIN<br>LWGADFDAEGNLEAIYVTDSDSNASIGMKKYFVGVNSAGKVAISAKEIKEDNIGAQVLGLFTLSTGQKIWNKT<br>NLEHHHHHH (SEQ ID NO: 521) |
| PRT-467 | MITSVWTKGVTPPTDFIKGEDVFHAPYKAGQGWYDITKAFDGGDDLLCGAATAGNMLHWWFDQNKDQIERYLK<br>EHPEKQKINFNGEQMFDVKEAIDTKDSQTNSELFNYFKEKAFPYLSTKHLGVFPDHVLDMFINGYRLSLINHG<br>PTPVKRQEKDPRGGIFDAVFGRGDQTKLLTSRHDLKNKTLNEISQLIKQELTEGKALGLSHTYANVRINHVIN<br>LWGADFDAEGNLEAIYVTDSDSNASIGMKKYFVGVNSAGKVAISAKEIKEDNIGAQVLGLFTLSTGQKIWNKT<br>NLEHHHHHH (SEQ ID NO: 522) |
| PRT-468 | MITSVWTKGVTPPTDFIKGEDVFHAPYKAGQGWYDITKAFDGGDDLLCGAATAGNMLHWWFDQNKDQIERYLK<br>EHPEKQKINFNGEQMFDVKEAIDTKDSQTNSELFNYFKEKAFPYLSTKHLGVFPDHVLDMFINGYRLSLINHG<br>PTPVKEGSKDPRGGIFDAVFTRGDQSKLLTSRHDLKNKTLNEISQLIKQELTEGKALGLSHTYANVRINHVIN<br>LWGADFDAEGNLEAIYVTDSDSNASIGMKKYFVGVNSAGKVAISAKEIKEDNIGAQVLGLFTLSTGQKIWNKT<br>NLEHHHHHH (SEQ ID NO: 523) |
| PRT-469 | MVTSVWTKGVTPPTDFIKGEDVFHAPYKAGQGWYDITKAFDGGDDLLCGAATAGNMLHWWFDQNKDQIERYLK<br>EHPEKQKINFNGEQMEDVKEAIDTKDSQTNSELFNYFKEKAFPYLSTKHLGVFPDHVLDMFINGYRLSLINHG<br>PTPVKRQEKDPRGGIFDAVEGRGDQTKLLTSRHDLKNKTLKEISDLIKQELTEGKALGLSHTYANVRINHVIN<br>LWGADFDSEGNLKAIYVTDSDSNASIGMKKYFVGVNSAGKVAISAKEIKEDNIGAQVLGLFTLSTGQKIWNKT<br>NLEHHHHHH (SEQ ID NO: 524) |
| PRT-470 | MVTSVWTKGVTPPTDFIYGEDVLHAPYKAGQGWYDITKTFNGKDDLLCGAATAGNMLHWWFDQNKEQIENYLK<br>KHPEKQKINFNGEQMEDVKEAIDTKDSQLDSKLFEYFKEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>NLEHHHHHH (SEQ ID NO: 525) |
| PRT-471 | MVTSVWTKGVTPPTDFIYGEDVLHAPYKAGQGWYDITKAFDGGDDLLCGAATAGNMLHWWFDQNKEQIENYLK<br>KHPEKQKINFNGEQMFDVKEAIDTKDSQTNSELFNYFKEKAFPYLSTKHLGVFPDHVIDMFINGYRLSLINHG<br>PTPVKRGSKDPRGGIFDAVFTRGDQSKLLTNRHDFKEKTLKEISDLIKQELTEGKALGISHTYANVRINHVIN<br>LWGADFDAEGNLEAIYVTDSDSNASIGMKKYFVGVNSNGKVAISAKEIEEDNIGAQVLGLFTLSTGQDIWNQT<br>NLEHHHHHH (SEQ ID NO: 526) |

TABLE 5-continued

| ID | Polypeptide having protease activity Seq |
|---|---|
| PRT-472 | MVTSVWTKGVTPPTDFIYGEDVLHAPYKAGQGWYDITKTFNGKDDLLCGAATAGNMLHWWFDQNKEQIENYLK KHPEKQKINFNGEQMEDVKEAIDTKDSQLDSKLFEYFKEKAFPYLSTKHLGVFPDHVIDMFINGYRLSLINHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNASIGMKKYFVGVNSNGKVAISAKEIEEDNIGAQVLGLFTLSTGQDIWNQT NLEHHHHHH (SEQ ID NO: 527) |
| PRT-473 | MVTSVWTKGVTPPTDERKIVDGNIAYYHAPYKAGQGWYDITKTFNGKDDLLCGAATAGNMLHWWFDQNKEQIE NYLKKHPEKQKINFNGEQMEDVKEAIDTKDSQLDSKLFEYFKEKAFPYLSTKHLGVFPDHVIDMFINGYRLSL TNHGPTPVKRGSKDPRGGIFDAVFTRGDQSKLLTNRHDFKEKTLKEISDLIKQELTEGKALGISHTYANVRIN HVINLWGADFDAEGNLEAIYVTDSDSNASIGMKKYFVGVNSNGKVAISAKEIEEDNIGAQVLGLFTLSTGQDI WNQTNLEHHHHHH (SEQ ID NO: 528) |
| PRT-474 | MVTSVWTKGVTPPTDERKIVDGNIAYYHAPYKAGQGWYDITKAFDGGDDLLCGAATAGNMLHWWFDQNKEQIE NYLKKHPEKQKINFNGEQMEDVKEAIDTKDSQTNSELFNYFKEKAFPYLSTKHLGVFPDHVIDMFINGYRLSL TNHGPTPVKRGSKDPRGGIFDAVFTRGDQSKLLTNRHDLKNKTLKEISDLIKQELTEGKALGISHTYANVRIN HVINLWGADFDAEGNLEAIYVTDSDSNASIGMKKYFVGVNSNGKVAISAKEIEEDNIGAQVLGLFTLSTGQDI WNQTNLEHHHHHH (SEQ ID NO: 529) |
| PRT-475 | MVTSVWTKGVTPPTNFRKIVDGNIAYYHAPYVANQGWYDITKTFNGKDDLLCGAATAGNMLHWWFDQNKEQIE NYLKKHPEKQKINFNGEQMEDVKEAIDTKDSQLDSKLFEYFKEKAFPYLSTKHLGVFPDHVIDMFINGYRLSL TNHGPTPVKRGSKDPRGGIFDAVFTRGDQSKLLTNRHDLKNKTLKEISDLIKQELTEGKALGISHTYANVRIN HVINLWGADFDAEGNLEAIYVTDSDSNASIGMKKYFVGVNSNGKVAISAKEIEEDNIGAQVLGLFTLSTGQDI WNQTNLEHHHHHH (SEQ ID NO: 530) |
| PRT-476 | MVTSVWTKGVTPPTNFTYGEDVLHAPYVANQGWYDITKAFDGGDDLLCGAATAGNMLHWWFDQNKEQIENYLK KHPEKQKINFNGEQMFDVKEAIDTKDSQTNSELFNYFKEKAFPYLSTKHLGVFPDHVIDMFINGYRLSLTNHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNASIGMKKYFVGVNSNGKVAISAKEIEEDNIGAQVLGLFTLSTGQDIWNQT NLEHHHHHH (SEQ ID NO: 531) |
| PRT-477 | MVTSVWTKGVTPPTNFTYGEDVLHAPYVANQGWYDITKTFNGKDDLLCGAATAGNMLHWWFDQNKEQIENYLK KHPEKQKINFNGEQMFDVKEAIDTKDSQLDSKLFEYFKEKAFPYLSTKHLGVFPDHVIDMFINGYRLSLINHG PTPVKRGSKDPRGGIFDAVFTRGDQSKLLTNRHDLKNKTLKEISDLIKQELTEGKALGISHTYANVRINHVIN LWGADFDAEGNLEAIYVTDSDSNASIGMKKYFVGVNSNGKVAISAKEIEEDNIGAQVLGLFTLSTGQDIWNQT NLEHHHHHH (SEQ ID NO: 532) |
| PRT-478 | MITSVWTKGVTPPTDFIYGEDVLHAPYKAGQGWYDITKAFDGGDDLLCGAATAGNMLHWWFDQNKEQIENYLK KHPEKQKINFNGEQMEDVKEAIDTKDSQTNSELFNYFKEKAFPYLSTKHLGVFPDHVIDMFINGYRLSLINHG PTPVKRQEKDPRGGIFDAVFGRGDQTKLLTNRHDFKEKTLNEISQLIKQELTEGKALGISHTYANVRINHVIN LWGADFDAEGNLEAIYVTDSDSNASIGMKKYFVGVNSNGKVAISAKEIEEDNIGAQVLGLFTLSTGQKIWNKT NLEHHHHHH (SEQ ID NO: 533) |
| PRT-479 | MITSVWTKGVTPPTDFIYGEDVLHAPYKAGQGWYDITKAFDGGDDLLCGAATAGNMLHWWFDQNKEQIENYLK KHPEKQKINFNGEQMFDVKEAIDTKDSQTNSELFNYFKEKAFPYLSTKHLGVFPDHVIDMFINGYRLSLINHG PTPVKRQEKDPRGGIFDAVFGRGDQTKLLTNRHDLKNKTLNEISQLIKQELTEGKALGISHTYANVRINHVIN LWGADFDAEGNLEAIYVTDSDSNASIGMKKYFVGVNSNGKVAISAKEIEEDNIGAQVLGLFTLSTGQKIWNKT NLEHHHHHH (SEQ ID NO: 534) |
| PRT-480 | MITSVWTKGVTPPTDFIYGEDVLHAPYKAGQGWYDITKAFDGGDDLLCGAATAGNMLHWWFDQNKEQIENYLK KHPEKQKINFNGEQMEDVKEAIDTKDSQTNSELFNYFKEKAFPYLSTKHLGVFPDHVIDMFINGYRLSLTNHG PTPVKRGSKDPRGGIFDAVFTRGDQSKLLTNRHDLKNKTLNEISQLIKQELTEGKALGISHTYANVRINHVIN LWGADFDAEGNLEAIYVTDSDSNASIGMKKYFVGVNSNGKVAISAKEIEEDNIGAQVLGLFTLSTGQDIWNQT NLEHHHHHH (SEQ ID NO: 535) |
| PRT-481 | MVTSVWTKGVTPPTDFIYGEDVLHAPYKAGQGWYDITKAFDGGDDLLCGAATAGNMLHWWFDQNKEQIENYLK KHPEKQKINFNGEQMFDVKEAIDTKDSQTNSELFNYFKEKAFPYLSTKHLGVFPDHVIDMFINGYRLSLINHG PTPVKRQEKDPRGGIFDAVFGRGDQTKLLTNRHDLKNKTLKEISDLIKQELTEGKALGISHTYANVRINHVIN LWGADFDAEGNLEAIYVTDSDSNASIGMKKYFVGVNSNGKVAISAKEIEEDNIGAQVLGLFTLSTGQKIWNKT NLEHHHHHH (SEQ ID NO: 536) |
| PRT-482 | MVTSVWTKGVTPPTDFIKGEDVFHAPYKAGQGWYDITKTFNGKDNLLCGAATAGNMLHWWFDQNKDQIEAYLK EHPEKQKIIFNNQELFDLKAAIDTKDDQTNSKLFEYFKEKAFPYLSTKHLGVFPDHVLDMFINGYRLSLTNHG PTPVKEGSKDKRGGIFDAVFTRGVQSKLLTSRHDFKEKTLKEISDLIKQELTEGKALALSHTYANVRINHVIN LWGADFDSNGNLEAIYVTDSDTNASIGMKKYFVGVNSAGKVAISAKEIEDDNIGAQVLGLFTLSTGQDIWNQT NLEHHHHHH (SEQ ID NO: 537) |
| PRT-483 | MVTSVWTKGVTPPTDFIKGEDVFHAPYKAGQGWYDITKTFNGKDNLLCGAATAGNMLHWWFDQNKDQIEAYLK EHPEKQKIIFNNQELFDLKAAIDTKDDQTNSKLFEYFKEKAFPYLSTKHLGVFPDHVLDMFINGYRLSLINHG PTPVKEGSKDRGGIFDAVETRGVQSKLLTSRHDLKNKTLKEISDLIKQELTEGKALALSHTYANVRINHVIN LWGADFDSNGNLEAIYVTDSDTNASIGMKKYFVGVNSAGKVAISAKEIEDDNIGAQVLGLFTLSTGQDIWNQT NLEHHHHHH (SEQ ID NO: 538) |
| PRT-484 | MVTSVWTKGVTPPTDFRKIVDGNIAYYHAPYKAGQGWYDITKAFDGGDNLLCGAATAGNMLHWWFDQNKDQIE AYLKEHPEKQKIIFNNQELFDLKAAIDTKDDQTNSELFNYFKEKAFPYLSTKHLGVFPDHVLDMFINGYRLSL TNHGPTPVKEGSKDKRGGIFDAVFTRGVQSKLLTSRHDLKNKTLKEISDLIKQELTEGKALALSHTYANVRIN HVINLWGADFDSNGNLEAIYVTDSDTNASIGMKKYFVGVNSAGKVAISAKEIEDDNIGAQVLGLFTLSTGQDI WNQTNLEHHHHHH (SEQ ID NO: 539) |

TABLE 5-continued

| ID | Polypeptide having protease activity Seq |
|---|---|
| PRT-485 | MVTSVWTKGVTPPANFTQGEDVFHAPYKANQGWYDITKTFNGKDNLLCGAATAGNMLHWWFDQNKDQIEAYLK EHPEKQKIIFNNQELFDLKAAIDTKDDQTNSKLFEYFKEKAFPYLSTKHLGVFPDHVLDMFINGYRLSLINHG PTPVKEGSKDKRGGIFDAVFTRGVQSKLLTSRHDLKNKTLKEISDLIKQELTEGKALALSHTYANVRINHVIN LWGADFDSNGNLEAIYVTDSDTNASIGMKKYFVGVNSAGKVAISAKEIEDDNIGAQVLGLFTLSTGQDIWNQT NLEHHHHHH (SEQ ID NO: 540) |
| PRT-486 | MVTSVWTKGVTPPTDFIKGEDVFHAPYKAGQGWYDITKTFNGKDNLLCGAATAGNMLHWWFDQNKDQIERYLK EHPEKQKIIFNNQELFDLKAAIDTKDSQTDSKLFEYFKEKAFPYLSTKHLGVFPDHVLDMFINGYRLSLINHG PTPVKEGSKDKRGGIFDAVETRGVQSKLLTSRHDFKEKTLKEISDLIKQELTEGKALGLSHTYANVRINHVIN LWGADFDSEGNLKAIYVTDSDTNASIGMKKYFVGVNSAGKVAISAKEIKEDNIGAQVLGLFTLSTGQDIWNQT NLEHHHHHH (SEQ ID NO: 541) |
| PRT-487 | MVTSVWTKGVTPPTDFIKGEDVFHAPYKAGQGWYDITKTFNGKDNLLCGAATAGNMLHWWFDQNKDQIERYLK EHPEKQKIIFNNQELFDLKAAIDTKDSQTDSKLFEYFKEKAFPYLSTKHLGVFPDHVLDMFINGYRLSLINHG PTPVKEGSKDKRGGIFDAVETRGVQSKLLTSRHDLKNKTLKEISDLIKQELTEGKALGLSHTYANVRINHVIN LWGADFDSEGNLKAIYVTDSDTNASIGMKKYFVGVNSAGKVAISAKEIKEDNIGAQVLGLFTLSTGQDIWNQT NLEHHHHHH (SEQ ID NO: 542) |
| PRT-488 | MVTSVWTKGVTPPTDERKIVDGNIAYYHAPYKAGQGWYDITKAFDGGDNLLCGAATAGNMLHWWFDQNKDQIE RYLKEHPEKQKIIFNNQELFDLKAAIDTKDSQTNSELFNYFKEKAFPYLSTKHLGVFPDHVLDMFINGYRLSL TNHGPTPVKEGSKDKRGGIFDAVFTRGVQSKLLTSRHDLKNKTLKEISDLIKQELTEGKALGLSHTYANVRIN HVINLWGADFDSEGNLKAIYVTDSDTNASIGMKKYFVGVNSAGKVAISAKEIKEDNIGAQVLGLFTLSTGQDI WNQTNLEHHHHHH (SEQ ID NO: 543) |
| PRT-489 | MVTSVWTKGVTPPANFTQGEDVFHAPYVANQGWYDITKTFNGKDNLLCGAATAGNMLHWWFDQNKDQIERYLK EHPEKQKIIFNNQELFDLKAAIDTKDSQTDSKLFEYFKEKAFPYLSTKHLGVFPDHVLDMFINGYRLSLINHG PTPVKEGSKDKRGGIFDAVFTRGVQSKLLTSRHDLKNKTLKEISDLIKQELTEGKALGLSHTYANVRINHVIN LWGADFDSEGNLKAIYVTDSDTNASIGMKKYFVGVNSAGKVAISAKEIKEDNIGAQVLGLFTLSTGQDIWNQT NLEHHHHHH (SEQ ID NO: 544) |
| PRT-490 | MVTSVWTKGVTPPTDFIYGEDVLHAPYKAGQGWYDITKTFNGKDNLLCGAATAGNMLHWWFDQNKEQIENYLK KHPEKQKIIFNNQELFDLKAAIDTKDSQLDSKLFEYFKEKAFPYLSTKHLGVFPDHVIDMFINGYRLSLINHG PTPVKRGSKDKRGGIFDAVFTRGVQSKLLTNRHDFKEKTLKEISDLIKQELTEGKALGISHTYANVRINHVIN LWGADFDAEGNLEAIYVTDSDTNASIGMKKYFVGVNSNGKVAISAKEIEEDNIGAQVLGLFTLSTGQDIWNQT NLEHHHHHH (SEQ ID NO: 545) |
| PRT-491 | MVTSVWTKGVTPPTDFIYGEDVLHAPYKAGQGWYDITKTFNGKDNLLCGAATAGNMLHWWFDQNKEQIENYLK KHPEKQKIIFNNQELFDLKAAIDTKDSQLDSKLFEYFKEKAFPYLSTKHLGVFPDHVIDMFINGYRLSLINHG PTPVKRGSKDKRGGIFDAVFTRGVQSKLLTNRHDLKNKTLKEISDLIKQELTEGKALGISHTYANVRINHVIN LWGADFDAEGNLEAIYVTDSDTNASIGMKKYFVGVNSNGKVAISAKEIEEDNIGAQVLGLFTLSTGQDIWNQT NLEHHHHHH (SEQ ID NO: 546) |
| PRT-492 | MVTSVWTKGVTPPTDERKIVDGNIAYYHAPYKAGQGWYDITKAFDGGDNLLCGAATAGNMLHWWFDQNKEQIE NYLKKHPEKQKIIFNNQELFDLKAAIDTKDSQTNSELFNYFKEKAFPYLSTKHLGVFPDHVLDMFINGYRLSL TNHGPTPVKRGSKDKRGGIFDAVFTRGVQSKLLTNRHDLKNKTLKEISDLIKQELTEGKALGISHTYANVRIN HVINLWGADFDAEGNLEAIYVTDSDTNASIGMKKYFVGVNSNGKVAISAKEIEEDNIGAQVLGLFTLSTGQDI WNQTNLEHHHHHH (SEQ ID NO: 547) |
| PRT-493 | MVTSVWTKGVTPPTNFTYGEDVLHAPYVANQGWYDITKTFNGKDNLLCGAATAGNMLHWWFDQNKEQIENYLK KHPEKQKIIFNNQELFDLKAAIDTKDSQLDSKLFEYFKEKAFPYLSTKHLGVFPDHVIDMFINGYRLSLINHG PTPVKRGSKDKRGGIFDAVFTRGVQSKLLTNRHDLKNKTLKEISDLIKQELTEGKALGISHTYANVRINHVIN LWGADFDAEGNLEAIYVTDSDTNASIGMKKYFVGVNSNGKVAISAKEIEEDNIGAQVLGLFTLSTGQDIWNQT NLEHHHHHH (SEQ ID NO: 548) |
| PRT-494 | MVTSVWTKGVTPPTDFIKGEDVFHAPYKAGQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVFTRGDQSKLLTSRHDFKEKGLKEISDLIKQELTEGKALGLSHTYANVRINHV INLWGADFDSDGNLKAIYVTDSDSNASIGMKKYFVGVNSAGKVAISAKEIKEDNIGAQVLGLFTLSTGQDIWN QTNLEHHHHHH (SEQ ID NO: 549) |
| PRT-495 | MVTSVWTKGVTPPTDFIKGEDVFHAPYKAGQGWYDITKAFDGGDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVETRGDQSKLLTSRHDFKEKGLKEISDLIKQELTEGKALGLSHTYANVRINHV INLWGADFDSDGNLKAIYVTDSDSNASIGMKKYFVGVNSAGKVAISAKEIKEDNIGAQVLGLFTLSTGQDIWN QTNLEHHHHHH (SEQ ID NO: 550) |
| PRT-496 | MVTSVWTKGVTPPTDFIKGEDVFHAPYKAGQGWYDITKTFNGKDDLLCGAATAGNMLHWWFDQNKEYIEAYLK KHPEKQKIMFGDQELLDVRKAINTKGSQKNSELFNYFRDKAFPNLSARRLGVMPDLVLDMFINGYYLNVTKTQ TTDVNRTYQEKDKRGGIFDAVETRGDQSKLLTSRHDLKNKGLKEISDLIKQELTEGKALGLSHTYANVRINHV INLWGADFDSDGNLKAIYVTDSDSNASIGMKKYFVGVNSAGKVAISAKEIKEDNIGAQVLGLFTLSTGQDIWN QTNLEHHHHHH (SEQ ID NO: 551) |
| PRT-497 | MVTSVWTKGVTPPTDERKIVDGNIAYYHAPYKAGQGWYDITKTFNGKDDLLCGAATAGNMLHWWFDQNKEYIE AYLKKHPEKQKIMFGDQELLDVRKAINTKGSQKNSELFNYFRDKAFPNLSARRLGVMPDLVLDMFINGYYLNV TKTQTTDVNRTYQEKDKRGGIFDAVFTRGDQSKLLTSRHDFKEKGLKEISDLIKQELTEGKALGLSHTYANVR INHVINLWGADFDSDGNLKAIYVTDSDSNASIGMKKYFVGVNSAGKVAISAKEIKEDNIGAQVLGLFTLSTGQ DIWNQTNLEHHHHHH (SEQ ID NO: 552) |

TABLE 5-continued

| ID | Polypeptide having protease activity Seq |
|---|---|
| PRT-498 | MVTSVWTKGVTPPTDFRKIVDGNIAYYHAPYKAGQGWYDITKAFDGGDDLLCGAATAGNMLHWWFDQNKEYIE<br>AYLKKHPEKQKIMFGDQELLDVRKAINTKGSQKNSELFNYFRDKAFPNLSARRLGVMPDLVLDMFINGYYLNV<br>TKTQTTDVNRTYQEKDKRGGIFDAVETRGDQSKLLTSRHDLKNKGLKEISDLIKQELTEGKALGLSHTYANVR<br>INHVINLWGADFDSDGNLKAIYVTDSDSNASIGMKKYFVGVNSAGKVAISAKEIKEDNIGAQVLGLFTLSTGQ<br>DIWNQTNLEHHHHHH (SEQ ID NO: 553) |
| PRT-499 | MVTSVWTKGVTPPADFRKIVDGNIAYYHAPYVANQGWYDITKTFNGKDDLLCGAATAGNMLHWWFDQNKEYIE<br>AYLKKHPEKQKIMFGDQELLDVRKAINTKGSQKNSELFNYFRDKAFPNLSARRLGVMPDLVLDMFINGYYLNV<br>TKTQTTDVNRTYQEKDKRGGIFDAVETRGDQSKLLTSRHDLKNKGLKEISDLIKQELTEGKALGLSHTYANVR<br>INHVINLWGADFDSDGNLKAIYVTDSDSNASIGMKKYFVGVNSAGKVAISAKEIKEDNIGAQVLGLFTLSTGQ<br>DIWNQTNLEHHHHHH (SEQ ID NO: 554) |
| PRT-500 | MVTSVWTKGVTPPADFTQGEDVFHAPYVANQGWYDITKAFDGGDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDLKNKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQDIWN<br>QTNLEHHHHHH (SEQ ID NO: 555) |
| PRT-501 | MVTSVWTKGVTPPADFTQGEDVFHAPYVANQGWYDITKTFNGKDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVFTRGDQSKLLTSRHDLKNKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQDIWN<br>QTNLEHHHHHH (SEQ ID NO: 556) |
| PRT-502 | MITSVWTKGVTPPTDFIKGEDVFHAPYKAGQGWYDITKAFDGGDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRQEQEKDKRGGIFDAVFGRGDQTKLLTSRHDFKEKGLNEISQLIKQELTEGKALGLSHTYANVRINHV<br>INLWGADFDADGNLEAIYVTDSDSNASIGMKKYFVGVNSAGKVAISAKEIKEDNIGAQVLGLFTLSTGQKIWN<br>KTNLEHHHHHH (SEQ ID NO: 557) |
| PRT-503 | MITSVWTKGVTPPTDFIKGEDVFHAPYKAGQGWYDITKAFDGGDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRQEQEKDKRGGIFDAVFGRGDQTKLLTSRHDLKNKGLNEISQLIKQELTEGKALGLSHTYANVRINHV<br>INLWGADFDADGNLEAIYVTDSDSNASIGMKKYFVGVNSAGKVAISAKEIKEDNIGAQVLGLFTLSTGQKIWN<br>KTNLEHHHHHH (SEQ ID NO: 558) |
| PRT-504 | MITSVWTKGVTPPTDFIKGEDVFHAPYKAGQGWYDITKAFDGGDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRTYQEKDKRGGIFDAVETRGDQSKLLTSRHDLKNKGLNEISQLIKQELTEGKALGLSHTYANVRINHV<br>INLWGADFDADGNLEAIYVTDSDSNASIGMKKYFVGVNSAGKVAISAKEIKEDNIGAQVLGLFTLSTGQDIWN<br>QTNLEHHHHHH (SEQ ID NO: 559) |
| PRT-505 | MVTSVWTKGVTPPTDFIKGEDVFHAPYKAGQGWYDITKAFDGGDDLLCGAATAGNMLHWWFDQNKEYIEAYLK<br>KHPEKQKIMFGDQELLDVRKAINTKGSQKNSELFNYFRDKAFPNLSARRLGVMPDLVLDMFINGYYLNVTKTQ<br>TTDVNRQEQEKDKRGGIFDAVFGRGDQTKLLTSRHDLKNKGLKEISDLIKQELTEGKALGLSHTYANVRINHV<br>INLWGADFDSDGNLKAIYVTDSDSNASIGMKKYFVGVNSAGKVAISAKEIKEDNIGAQVLGLFTLSTGQKIWN<br>KTNLEHHHHHH (SEQ ID NO: 560) |
| PRT-506 | MITSVWTKGVTPPTDFIKGEDVFHAPYKAGQGWYDITKTFNGKDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDFKEKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQDIWN<br>QTNLEHHHHHH (SEQ ID NO: 561) |
| PRT-507 | MITSVWTKGVTPPTDFIKGEDVFHAPYKAGQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDFKEKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQDIWN<br>QTNLEHHHHHH (SEQ ID NO: 562) |
| PRT-508 | MITSVWTKGVTPPTDFIKGEDVFHAPYKAGQGWYDITKTFNGKDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDLKNKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQDIWN<br>QTNLEHHHHHH (SEQ ID NO: 563) |
| PRT-509 | MITSVWTKGVTPPTDERKIVDGNIAYYHAPYKAGQGWYDITKTFNGKDDLLCGAATAGNMLHWWFDQNKEEIE<br>AYLKKHPEKQKIMFGDQELLDVRKVINTKDSQTNSALFNYFKDKAFPNLSARRLGVMPDLVLDMFINGYYLNV<br>YKTQTTDVNRTYQTKDRRGGIFDAVFTRGDQSKLLTERHDFKEKTLKEISDLIKQELTEGKALGLSHTYANVR<br>INHVINLWGADFDSNGNLEAIYVTDSDSNASIGMKKYFVGVNSAGKVAISAKEIKEDNIGAQVLGLFTLSTGQ<br>DIWNQTNLEHHHHHH (SEQ ID NO: 564) |
| PRT-510 | MITSVWTKGVTPPTDERKIVDGNIAYYHAPYKAGQGWYDITKAFDGGDDLLCGAATAGNMLHWWFDQNKEEIE<br>AYLKKHPEKQKIMFGDQELLDVRKVINTKDSQTNSALFNYFKDKAFPNLSARRLGVMPDLVLDMFINGYYLNV<br>YKTQTTDVNRTYQTKDRRGGIFDAVFTRGDQSKLLTERHDLKNKTLKEISDLIKQELTEGKALGLSHTYANVR<br>INHVINLWGADFDSNGNLEAIYVTDSDSNASIGMKKYFVGVNSAGKVAISAKEIKEDNIGAQVLGLFTLSTGQ<br>DIWNQTNLEHHHHHH (SEQ ID NO: 565) |

TABLE 5-continued

| ID | Polypeptide having protease activity Seq |
|---|---|
| PRT-511 | MITSVWTKGVTPPAKFRKIVDGNIAYYHAPYVANQGWYDITKTFNGKDDLLCGAATAGNMLHWWFDQNKEEIE<br>AYLKKHPEKQKIMFGDQELLDVRKVINTKDSQTNSALFNYFKDKAFPNLSARRLGVMPDLVLDMFINGYYLNV<br>YKTQTTDVNRTYQTKDRRGGIFDAVFTRGDQSKLLTERHDLKNKTLKEISDLIKQELTEGKALGLSHTYANVR<br>INHVINLWGADFDSNGNLEAIYVTDSDSNASIGMKKYFVGVNSAGKVAISAKEIKEDNIGAQVLGLFTLSTGQ<br>DIWNQTNLEHHHHHH (SEQ ID NO: 566) |
| PRT-512 | MITSVWTKGVTPPAKFTQGEDVFHAPYVANQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDLKNKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQDIWN<br>QTNLEHHHHHH (SEQ ID NO: 567) |
| PRT-513 | MITSVWTKGVTPPAKFTQGEDVFHAPYVANQGWYDITKTFNGKDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDLKNKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQDIWN<br>QTNLEHHHHHH (SEQ ID NO: 568) |
| PRT-514 | MITSVWTKGVTPPTDFIKGEDVFHAPYKAGQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRQEQTKDRRGGIFDAVFGRGDQTKLLTERHDFKEKTLNEISQLIKQELTEGKALGLSHTYANVRINHV<br>INLWGADFDAEGNLEAIYVTDSDSNASIGMKKYFVGVNSAGKVAISAKEIKEDNIGAQVLGLFTLSTGQKIWN<br>KTNLEHHHHHH (SEQ ID NO: 569) |
| PRT-515 | MITSVWTKGVTPPTDFIKGEDVFHAPYKAGQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRQEQTKDRRGGIFDAVFGRGDQTKLLTERHDLKNKTLNEISQLIKQELTEGKALGLSHTYANVRINHV<br>INLWGADFDAEGNLEAIYVTDSDSNASIGMKKYFVGVNSAGKVAISAKEIKEDNIGAQVLGLFTLSTGQKIWN<br>KINLEHHHHHH (SEQ ID NO: 570) |
| PRT-516 | MITSVWTKGVTPPTDFIKGEDVFHAPYKAGQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRTYQTKDRRGGIFDAVFTRGDQSKLLTERHDLKNKTLNEISQLIKQELTEGKALGLSHTYANVRINHV<br>INLWGADFDAEGNLEAIYVTDSDSNASIGMKKYFVGVNSAGKVAISAKEIKEDNIGAQVLGLFTLSTGQDIWN<br>QTNLEHHHHHH (SEQ ID NO: 571) |
| PRT-517 | MITSVWTKGVTPPTDFIKGEDVFHAPYKAGQGWYDITKAFDGGDDLLCGAATAGNMLHWWFDQNKEEIEAYLK<br>KHPEKQKIMFGDQELLDVRKVINTKDSQTNSALFNYFKDKAFPNLSARRLGVMPDLVLDMFINGYYLNVYKTQ<br>TTDVNRQEQTKDRRGGIFDAVFGRGDQTKLLTERHDLKNKTLKEISDLIKQELTEGKALGLSHTYANVRINHV<br>INLWGADFDSNGNLEAIYVTDSDSNASIGMKKYFVGVNSAGKVAISAKEIKEDNIGAQVLGLFTLSTGQKIWN<br>KTNLEHHHHHH (SEQ ID NO: 572) |
| PRT-518 | MVTSVWTKGVTPPTDFIKGEDVFHAPYKAGQGWYDITKTFNGKDNLLCGAATAGNMLHWWFDQNKEYIEAYLK<br>KHPEKQKIIFNNQELFDLKAAINTKGSQKNSELFNYFRDKAFPNLSARRLGVFPDLVLDMFINGYYLNVTKTQ<br>TTDVNRTYQEKDKRGGIFDAVFTRGVQSKLLTSRHDFKEKGLKEISDLIKQELTEGKALGLSHTYANVRINHV<br>INLWGADFDSDGNLKAIYVTDSDTNASIGMKKYFVGVNSAGKVAISAKEIKEDNIGAQVLGLFTLSTGQDIWN<br>QTNLEHHHHHH (SEQ ID NO: 573) |
| PRT-519 | MVTSVWTKGVTPPTDFIKGEDVFHAPYKAGQGWYDITKTFNGKDNLLCGAATAGNMLHWWFDQNKEYIEAYLK<br>KHPEKQKIIFNNQELFDLKAAINTKGSQKNSELFNYFRDKAFPNLSARRLGVFPDLVLDMFINGYYLNVTKTQ<br>TTDVNRTYQEKDKRGGIFDAVETRGVQSKLLTSRHDLKNKGLKEISDLIKQELTEGKALGLSHTYANVRINHV<br>INLWGADFDSDGNLKAIYVTDSDTNASIGMKKYFVGVNSAGKVAISAKEIKEDNIGAQVLGLFTLSTGQDIWN<br>QTNLEHHHHHH (SEQ ID NO: 574) |
| PRT-520 | MVTSVWTKGVTPPTDFRKIVDGNIAYYHAPYKAGQGWYDITKAFDGGDNLLCGAATAGNMLHWWFDQNKEYIE<br>AYLKKHPEKQKIIFNNQELFDLKAAINTKGSQKNSELFNYFRDKAFPNLSARRLGVFPDLVLDMFINGYYLNV<br>TKTQTTDVNRTYQEKDKRGGIFDAVETRGVQSKLLTSRHDLKNKGLKEISDLIKQELTEGKALGLSHTYANVR<br>INHVINLWGADFDSDGNLKAIYVTDSDTNASIGMKKYFVGVNSAGKVAISAKEIKEDNIGAQVLGLFTLSTGQ<br>DIWNQTNLEHHHHHH (SEQ ID NO: 575) |
| PRT-521 | MVTSVWTKGVTPPADFTQGEDVFHAPYVANQGWYDITKTFNGKDNLLCGAATAGNMLHWWFDQNKEYIEAYLK<br>KHPEKQKIIFNNQELFDLKAAINTKGSQKNSELFNYERDKAFPNLSARRLGVFPDLVLDMFINGYYLNVTKTQ<br>TTDVNRTYQEKDKRGGIFDAVFTRGVQSKLLTSRHDLKNKGLKEISDLIKQELTEGKALGLSHTYANVRINHV<br>INLWGADFDSDGNLKAIYVTDSDTNASIGMKKYFVGVNSAGKVAISAKEIKEDNIGAQVLGLFTLSTGQDIWN<br>QTNLEHHHHHH (SEQ ID NO: 576) |
| PRT-522 | MITSVWTKGVTPPTDFIKGEDVFHAPYKAGQGWYDITKTFNGKDNLLCGAATAGNMLHWWFDQNKEEIEAYLK<br>KHPEKQKIIFNNQELFDLKAVINTKDSQTNSALFNYFKDKAFPNLSARRLGVFPDLVLDMFINGYYLNVYKTQ<br>TTDVNRTYQTKDRRGGIFDAVFTRGVQSKLLTERHDFKEKTLKEISDLIKQELTEGKALGLSHTYANVRINHV<br>INLWGADFDSNGNLEAIYVTDSDTNASIGMKKYFVGVNSAGKVAISAKEIKEDNIGAQVLGLFTLSTGQDIWN<br>QTNLEHHHHHH (SEQ ID NO: 577) |
| PRT-523 | MITSVWTKGVTPPTDFIKGEDVFHAPYKAGQGWYDITKTFNGKDNLLCGAATAGNMLHWWFDQNKEEIEAYLK<br>KHPEKQKIIFNNQELFDLKAVINTKDSQTNSALFNYFKDKAFPNLSARRLGVFPDLVLDMFINGYYLNVYKTQ<br>TTDVNRTYQTKDRRGGIFDAVFTRGVQSKLLTERHDLKNKTLKEISDLIKQELTEGKALGLSHTYANVRINHV<br>INLWGADFDSNGNLEAIYVTDSDTNASIGMKKYFVGVNSAGKVAISAKEIKEDNIGAQVLGLFTLSTGQDIWN<br>QTNLEHHHHHH (SEQ ID NO: 578) |

TABLE 5-continued

| ID | Polypeptide having protease activity Seq |
|---|---|
| PRT-524 | MITSVWTKGVTPPTDFRKIVDGNIAYYHAPYKAGQGWYDITKAFDGGDNLLCGAATAGNMLHWWFDQNKEEIE<br>AYLKKHPEKQKIIFNNQELFDLKAVINTKDSQTNSALFNYFKDKAFPNLSARRLGVFPDLVLDMFINGYYLNV<br>YKTQTTDVNRTYQTKDRRGGIFDAVFTRGVQSKLLTERHDLKNKTLKEISDLIKQELTEGKALGLSHTYANVR<br>INHVINLWGADFDSNGNLEAIYVTDSDTNASIGMKKYFVGVNSAGKVAISAKEIKEDNIGAQVLGLFTLSTGQ<br>DIWNQTNLEHHHHHH (SEQ ID NO: 579) |
| PRT-525 | MITSVWTKGVTPPAKFTQGEDVFHAPYVANQGWYDITKTFNGKDNLLCGAATAGNMLHWWFDQNKEEIEAYLK<br>KHPEKQKIIFNNQELFDLKAVINTKDSQTNSALFNYFKDKAFPNLSARRLGVFPDLVLDMFINGYYLNVYKTQ<br>TTDVNRTYQTKDRRGGIFDAVFTRGVQSKLLTERHDLKNKTLKEISDLIKQELTEGKALGLSHTYANVRINHV<br>INLWGADFDSNGNLEAIYVTDSDTNASIGMKKYFVGVNSAGKVAISAKEIKEDNIGAQVLGLFTLSTGQDIWN<br>QTNLEHHHHHH (SEQ ID NO: 580) |
| PRT-526 | MANQEIRYSEETPKTITSVWTKGVTPPTDFIKNEDVLHAPYIANQGWYDITKTFNGKDDLLCGAATAGNMLHW<br>WFDQNKEEIERYLKKHPEKQKINFNGEQMEDVKEAIDTKDSQTDSALFEYFKDKAFPNLSTKHLGVMPDHVLD<br>MFINGYYLSLGKHGPTPVKRGTKDPRGGIFDAVFTRGDQSKLLTSRHDFKEKTLKEISDLIKQELTEGKALAL<br>SHTYANVRINHVINLWGADFDSEGNLEAIYVTDSDSNASIGMKKYYVGVNSAGKVAISAKEIEGDNIGAQVLG<br>LFTLSTGQDIWEQTNLEHHHHHH (SEQ ID NO: 581) |
| PRT-527 | MANQEIRYSEETPKTITSVWTKGVTPPTDFIKNEDVLHAPYIANQGWYDITKTFNGKDDLLCGAATAGNMLHW<br>WFDQNKEEIENYLKKHPEKQKINFNGEQMFDVKEAIDTKDSQTDSALFEYFKDKAFPNLSTKHLGVMPDLVLD<br>MFINGYYLSLGKHGPTPVKRGTKDPRGGIFDAVFTRGDQSKLLTSRHDFKEKTLNEISDLIKQELTEGKALAL<br>SHTYANVRINHVINLWGADFNSEGNLEAIYVTDSDSNASIGMKKYYVGVNSAGKVAISAKEIEGDNIGAQVLG<br>LFTLSTGQDIWEQTNLEHHHHHH (SEQ ID NO: 582) |
| PRT-528 | MANQEIRYSEETPKTITSVWTKGVTPPTDFIQNEDVLHAPYIANQGWYDITKTFNGKDDLLCGAATAGNMLHW<br>WFDQNKEEIENYLKKHPEKQKINFNGEQMEDVKEAIDTKDSQTDSALFEYFKDKAFPNLSTKHLGVMPDLVLD<br>MFINGYYLSLGKHGPTPVKRGTKDPRGGIFDAVFTRGDQSKLLTARHDFKEKTLNEISDLIKQELTEGKALAL<br>SHTYANVRINHVINLWGADENSEGNLEAIYVTDSDSNASIGMKKYYVGVNAAGKVAISAKEIEGDNIGAQVLG<br>LFTLSTGQDIWEQTNLEHHHHHH (SEQ ID NO: 583) |
| PRT-529 | MANQEIRYSEETPKTITSVWTKGVTPPTDFIKNEDVLHAPYIANQGWYDITKTFNGKDDLLCGAATAGNMLHW<br>WFDQNKEEIENYLKKHPEKQKINENGEQMFDVKEAIDTKDSQTDSALFEYFKDKAFPNLSTKHLGVMPDLVLD<br>MFINGYYLSLGKHGPTPVKRGTKDPRGGIFDAVFTRGDQTKLLTARHDFKEKTLNEISDLIKQELTEGKALAL<br>SHTYANVRINHVINLWGADENSEGNLEAIYVTDSDSNASIGMKKYYVGVNAAGKVAISAKEIEGDNIGAQVLG<br>LFTLSTGQDIWEQTNLEHHHHHH (SEQ ID NO: 584) |
| PRT-530 | MANQEIRYSEETPKTITSVWTKGVTPPTDFIQNEDVLHAPYIANQGWYDITKTFNGKDDLLCGAATAGNMLHW<br>WFDQNKEEIENYLKKHPEKQKINFNGEQMFDVKEAIDTKDSQTDSALFEYFKDKAFPYLSTKHLGVMPDLVLD<br>MFINGYYLSVGKHGPTPVKRGTKDPRGGIFDAVFTRGDQSKLLTARHDFKEKTLNEISDLIKQELTEGKALAL<br>SHTYANVRINHVINLWGADENSEGNLEAIYVTDSDSNASIGMKKYYVGVNAAGKVAISAKEIEGDNIGAQVLG<br>LFTLSTGQDIWEQTNLEHHHHHH (SEQ ID NO: 585) |
| PRT-531 | MANQEIRYSEDTPSHITSVWTKGVTPPTQFIQNEDVLHAPYIANQGWYDITKTFNGKDDLLCGAATAGNMLHW<br>WFDQNKEQIEAYLKKYPEKQKINFNGEQMEDVKEAIDTKDSQTDSALFNYERDKAFPNLSTKHEAGYGDAGIN<br>MFINGYRLNLGNHGPTPVKNQTKDLRGGIFDAVFTRGDQSKLLTARHDFKEKTLKEISQLIKQELTEGKALAL<br>SHTYANVRINHVINLWGADFNAEGNLEAIYVTDSDSNASIGMKKYYVGVNAAGKVAISAKEIEGDNIGAQVLG<br>LFTLSSGQDIWQQTNLEHHHHHH (SEQ ID NO: 586) |
| PRT-532 | MANQEIRYSEETPKTITSIWTKGVTPPTDFIKNEDVLHAPYIANQGWYDITKTFNGKDDLLCGAATAGNMLHW<br>WFDQNKEEIENYLKKHPEKQKINFNGEQMEDVKEAIDTKDSQTDSKLFEYFKDKAFPYLSTKHLGVMPDLVLD<br>MFINGYYLSLGKHGPTPVKRGTKDPRGGIFDAVFTRGDQSKLLTARHDFKEKTLNEISDLIKQELTEGKALAL<br>SHTYANVRINHVINLWGADENSEGNLEAIYVTDSDSNASIGMKKYYVGVNAAGKVAISAKEIEGDNIGAQVLG<br>LFTLSTGQDIWNQTNLEHHHHHH (SEQ ID NO: 587) |
| PRT-533 | MANQEIRYSSDSEWANKKVWVYGITPPEEGAWKYSTYYLPWKKEYGWYDCNKRNPTADGMMCWAATASNLLHW<br>WIAQNKEYIDLYGDKYKGPDKINFNGEQMFDVKEYIDPLDKPQESDIFQCFIDKSFADLSTKHEAGYGDAGIN<br>WFIHGIIPSSPAHGPTPVKLDYPYNPAGYFKDVFPRGDGVVLLGNNGDFKELSKERFNETIKDALKNKKAIGL<br>SIGPVNVRSSHVVTIWGAEFDENGDVSYIYMADNNDRWGVGCIRYQIVYEEGGTYTCYKTEIIPSDRPIPINR<br>LVTLELGEEYWKQTNLEHHHHHH (SEQ ID NO: 588) |
| PRT-534 | MANQEIRYSSDSEWANKKVWVYGITPPEEGAWKYSTYYLPWKKEYGWYDCNKRNPTADGMMCWAATASNLLHW<br>WIAQNKEYIDLYGDKYKGPDKINFNGEQMFDVKEYIDPLDKPQESDIFQCFIDKSFADLSTKHEAGYGDAGIN<br>WFIHGIIPSSPAHGPTPVKLDYPYNPAGYFKDVFPRGDGVVLLGNNGDFKELSKERFNETIKDALKNKKAIGL<br>SIGPVNVRSSHVVTIWGAEFDENGDVSYIYMADNNDNWGVGCIRYQIVYEEGGTYTCYKTEIIPSDRPIPINR<br>LVTLELGEEYWKQTNLEHHHHHH (SEQ ID NO: 589) |
| PRT-535 | MANQEIRYSGDSEWANKKVWVYGITPPEEKAWFYSTYYLPWKKEYGWYDCNKRNPTADGMMCWAATASNLMHW<br>WIAQNKEYIDLYGDKYKGPDKINFNGEQMFDVKEYIDPLDKPQESDIFQCFIDKAFADLSTKHEAGKGDEGIN<br>WFIHGIIPSYPAHGPTPVKLRYPYNPAGYFKDVFPRGDGVVLLGNNGDFKELGKERFNETIKDALANKKGIGL<br>SIGPVNVRSSHVVTMWGAEFDENGDVSYIYMADNNDRWGVGCIRYQIVYEGGTYTCYKTEIIGSDRPIPINR<br>LVTLELGEEYWKQTNLEHHHHHH (SEQ ID NO: 590) |
| PRT-536 | MANQEIRYSGDSEWANKKVWVYGITPAEEGAWLYSTYYLPWKKEYGWYDCNKRNPTADGMMCWAASASNLMHW<br>WIAQNKRYIDLYGDRYKGPDKINFNGEQMFDVKEYIDPLDKPQESDIFQCFIDKSFADLSTKHEAGKGDEGIN<br>WFIHGIIPSYPAHGPTPVKLRYPYNPAGYFKDVFPRGDGVVLGGNNGDFKELGKERFNETIKDALANKKGIGL<br>SIGPVNVRKSHVETMWGAEFDENGDVSYIYMADNNDRWGVGCIRLQIVYEGATYTCYKTEIIPSDRPIPINR<br>LVTVELGEEYWKQTNLEHHHHHH (SEQ ID NO: 591) |

TABLE 5-continued

| ID | Polypeptide having protease activity Seq |
|---|---|
| PRT-537 | MANQEIRYSSDSEWANKKVWVYGITPPEEGAWFYSTYYLPWKKEYGWYDCNKRNPTADGMMCWAASASNLLHW<br>WIAQNKEYIDLYGDKYKGPDKINFNGEQMFDVKEYIDPLDKPQESDIFQCFIDKSFADLSTKHEAGKGDAGIN<br>WFIHGIIPSSPAHGPTPVKLRYPYNPAGYFKDVFPRGDGVVLLGNNGDFKELGKERFNETIKDALANKKGIGL<br>SIGPVNVRSSHVVTIWGAEFDENGDVSYIYMADNNDRWGVGCIRYQIVYEEGGTYTCYKTEIIPSDRPIPINR<br>LVTLELGEEYWKQTNLEHHHHHH (SEQ ID NO: 592) |
| PRT-538 | MANQEIRYSSDSEWANKKVWVYGITPPEEGAWKYSTYYLPWKKEYGWYDCNKRNPTADGMMCWAATASNLLHW<br>WIAQNKEYIDLYGDKYKGPDKINFNGEQMFDVKEYIDPLDKPQESDIFQCFIDKSFADLSTKHEAGYGDEGIN<br>WFIHGIIPSSPAHGPTPVKLRKPYNPAGYFKDVFPRGDGVKLLSNNGDFKELGKERFNETIKDALKNKKGIGL<br>SIGPVNVRSGHVVTMWGAEFDENGDVSYIYIADNNDRWGVGCIRYQIVYEEGGTYTCYKTEIINEDRPIPINR<br>LVTLELGEEYWKQTNLEHHHHHH (SEQ ID NO: 593) |
| PRT-539 | MANQEIRYSKNENPNVTIKWVHGIGEPTQAEKEKIEFYWYETNTTKFFNNRKVTHLGDSNQCWAKTASNMLHW<br>WFEQNKENINKYIEKKNITGKINFNGEQMFDVKEGIDDNQEKEKSYIANTFRTKKAHNLSTKHKGDYIISGLA<br>WYLYGLNNFKNAHGPTPVKKKPKFYGPALFKDVFNRGDGNTPIKEETDFKEYTKKEFEDILKEALDSKKAIGI<br>NIYGSNVGYGHAITLWGAAFDEDNNIIAIYVVDNNFKFENRIFPPYGIWYEKEGRPYLFNYEINSFVKNRYVGE<br>ITTLDKGEAQWQETNLEHHHHHH (SEQ ID NO: 594) |
| PRT-540 | MANQEIRYSKNENPNVTIKWVHGIGEPTQAEKEKIEFYWYETNTTKFFNNRKVTHLGDSNQCWAKTASNMLHW<br>WFVQNKENINKYIEKKNITGKINFNGEQMFDVKEGIDDNQEKEKSYIANTFRTKKAHNLSTKHKGDYIINGLA<br>WYLYGLNNFKNAHGPTPVKKKPKFYGPALFKDVFNRGDGNTPIIEETDFKEYTKKEFEDTLSEALDSKKAIGI<br>NIYGSNVDYGHAITLWGAAFDEDENIIAIYVVDNNFKFENRIFPPYGIWYEKEGRPYLFNYEINSFVKNRYVGE<br>ITTLDKGEAQWQETNLEHHHHHH (SEQ ID NO: 595) |
| PRT-541 | MANQEIRYSKNENPNVTIKWVHGIGEPTQAEKEKIEFWWYETTTTKFFNNRKVDHLGDGNQCWAKTDSNMLHW<br>WFVQNEENINQYIAKKNITGKINFNGEQMFDVKEGIDDNQEKEKSYIANTFRTKKAHNLSTKHKGDYIINGLS<br>WYLYGLNNFKIAHGPTPVKKKPKFYGPALFKDVFSRGDGNTPIIVETDFKEYTKKEFEDTLSAALDSKKAIGI<br>NIYGSNVDYQHAITLWGAAFDEEENIIAIYVVDNNFKFENRIFPPYGIWYQKEGRPYLFNYEINSFVKNRYVGE<br>VTTLDKGEAQWQETNLEHHHHHH (SEQ ID NO: 596) |
| PRT-542 | MANQEIRYSKNENPNVTIKWVHGIGEPTQAEKEKIEFWWYETTTTKFFNNRKVDHLGDGNQCWAKTDSNMLHW<br>WFVQNEENINQYIEKKNITGKINFNGEQMFDVKEGIDDNQEPEKSYIANTERTKKAHNLSTKHKGDYIINGLS<br>WYLYGLNNFKNAHGPTPVKKKPKFYGPALFKDVFNRGDGNTPIIVETDFKEYTKKEFEDTLSAALDSKKAVGI<br>NIYGSNVDYQHAITLWGAAFDEEENIIAIYVVDNNFKFENRIFPPYGIWYQKEGRPYLFNYEINSFVKNRYVGE<br>ITTLDKGEAQWQETNLEHHHHHH (SEQ ID NO: 597) |
| PRT-543 | MANQEIRYSKNENPNVTIKWVHGIGEPTQSEKEKIEFWWYETTTTKFFNNRKVDPLGDGNQCWAKTDSNMLHW<br>WFVQNEENINQYIEKKNITGKINFNGEQMEDVKEGIDDNQEPEKSYIANTFRTKKAHNLSTKHKGDYIINGLS<br>WYLYGLNNFKNAHGPTPVKKKPKFYGPALFKDVFNRGDGNTPIIVETDFKEYTKKEFEDTLSAALDSKKAIGI<br>NIYGSNVDYQHAITLWGAAFDEEENIIAIYVVDNNFKFENRIFPPYGIWYEKEGRPYLFNYEINSFVKNRYVGE<br>ITTLDKGEAQWQETNLEHHHHHH (SEQ ID NO: 598) |
| PRT-544 | MANQEIRYSKNENPNVTIKWVHGIGEPTQAEKEKIEFWWYETTTTKFFNNRKVDHLGDGNQCWAKTDSNMLHW<br>WFVQNEENINQYIAKKNITGKINFNGEQMEDVKEGIDDNQEKEKSYIANTFRTKKAHNLSTKHKGDYIINGLS<br>WYLYGLNNFKIAHGPTPVKKKPKFYGPALFKDVENRGDGNTPIIVETDFKEYTKKEFEDTLSAALDSKKAIGI<br>NIYGSNVDYQHAITLWGAAFDEEENIIAIYVVDNNEKFENRIFPPYGIWYQKEGRPYLFNYEINSFVKNRYVGE<br>VITLDKGEAQWQETNLEHHHHHH (SEQ ID NO: 599) |
| PRT-545 | MANQEIRYSEETPKTITSVWTKGVTPPTDFIKNEDVLHAPYIANQGWYDITKTFNGKDDLLCGAATAGNMLHW<br>WFDQNKEEIERYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLKEISDLIKQELTEGKALGL<br>SHTYANVRINHVINLWGADFDSEGNLEAIYVTDSDSNASIGMKKYYVGVNSAGKVAISAKEIEGDNIGAQVLG<br>LFTLSTGQDIWEQTNLEHHHHHH (SEQ ID NO: 600) |
| PRT-546 | MANQEIRYSEETPKTITSVWTKGVTPPTDFIKNEDVLHAPYIANQGWYDITKTFNGKDDLLCGAATAGNMLHW<br>WFDQNKEEIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADENSEGNLEAIYVTDSDSNASIGMKKYYVGVNSAGKVAISAKEIEGDNIGAQVLG<br>LFTLSTGQDIWEQTNLEHHHHHH (SEQ ID NO: 601) |
| PRT-547 | MANQEIRYSEETPKTITSVWTKGVTPPTDFIQNEDVLHAPYIANQGWYDITKTFNGKDDLLCGAATAGNMLHW<br>WFDQNKEEIENYLKKHPEKQKINFNGEQMFDVKEAIDTKDSQTDSALFEYFKDKAFPYLSTKHLGVFPDHVID<br>MFINGYRLSLINHGPTPVKRGTKDPRGGIFDAVFTRGDQSKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWEQTNLEHHHHHH (SEQ ID NO: 602) |
| PRT-548 | MANQEIRYSEETPKTITSVWTKGVTPPTDFIKNEDVLHAPYIANQGWYDITKTFNGKDDLLCGAATAGNMLHW<br>WFDQNKEEIENYLKKHPEKQKINFNGEQMEDVKEAIDTKDSQTDSALFEYFKDKAFPYLSTKHLGVFPDHVID<br>MFINGYRLSLTNHGPTPVKRGTKDPRGGIFDAVFTRGDQTKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWEQTNLEHHHHHH (SEQ ID NO: 603) |
| PRT-549 | MANQEIRYSEDTPSHITSVWTKGVTPPTQFIQNEDVLHAPYIANQGWYDITKTFNGKDDLLCGAATAGNMLHW<br>WFDQNKEQIEAYLKKYPEKQKINFNGEQMFDVKEAIDTKDSQTDSALFNYFKDKAFPYLSTKHLGVFPDHVID<br>MFINGYRLSLTNHGPTPVKNQTKDPRGGIFDAVETRGDQSKLLTARHDFKEKTLKEISQLIKQELTEGKALGL<br>SHTYANVRINHVINLWGADFNAEGNLEAIYVTDSDSNASIGMKKYYVGVNAAGKVAISAKEIEGDNIGAQVLG<br>LFTLSTGQDIWQQTNLEHHHHHH (SEQ ID NO: 604) |

TABLE 5-continued

| ID | Polypeptide having protease activity Seq |
|---|---|
| PRT-550 | MANQEIRYSEETPKTITSIWTKGVTPPTDFIKNEDVLHAPYIANQGWYDITKTFNGKDDLLCGAATAGNMLHW<br>WFDQNKEEIENYLKKHPEKQKINFNGEQMFDVKEAIDTKDSQTDSKLFEYFKDKAFPYLSTKHLGVFPDHVID<br>MFINGYRLSLINHGPTPVKRGTKDPRGGIFDAVFTRGDQSKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWNQTNLEHHHHHH (SEQ ID NO: 605) |
| PRT-551 | MANQEIRYSEETPSTITSVWTKGVTPPTDFIQNEDVLHAPYIANQGWYDITKTFNGKDDLLCGAATAGNMLHW<br>WFDQNKEEIENYLKKHPEKQKINFNGEQMFDVKEAIDTKDSQTDSALFEYFKDKAFPYLSTKHLGVFPDHVID<br>MFINGYRLSLINHGPTPVKRGTKDPRGGIFDAVFTRGDQSKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWNQTNLEHHHHHH (SEQ ID NO: 606) |
| PRT-552 | MANQEIRYSEETPKTITSVWTKGVTPPTDFIQNEDVLHAPYIANQGWYDITKTFNGKDDLLCGAATAGNMLHW<br>WFDQNKEEIENYLKKHPEKQKINFNGEQMFDVKEAIDTKDSQTDSALFEYFKDKAFPYLSTKHLGVFPDHVID<br>MFINGYRLSLTNHGPTPVKRGTKDPRGGIFDAVFTRGDQSKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWNQTNLEHHHHHH (SEQ ID NO: 607) |
| PRT-553 | MANQEIRYSEETPKTITSIWTKGVTPPTDFIKNEDVLHAPYVANQGWYDITKTFNGKDDLLCGAATAGNMLHW<br>WFDQNKEEIENYLKKHPEKQKINFNGEQMEDVKEAIDTKDSQTDSKLFEYFKDKAFPYLSTKHLGVFPDHVID<br>MFINGYRLSLTNHGPTPVKRGTKDPRGGIFDAVFTRGDQTKLLTERHDFKEKTLNEISDLIKQELTEGKALGL<br>SHTYANVRINHVINLWGADFNSEGNLEAIYVTDSDSNASIGMKKYYVGVNAAGKVAISAKEIEDDNIGAQVLG<br>LFTLSTGKDIWEQTNLEHHHHHH (SEQ ID NO: 608) |
| PRT-554 | MANQEIRYSEETPKTITSVWTKGVTPPTDFIKNEDVFHAPYVANQGWYDITKTFNGKDDLLCGAATAGNMLHW<br>WFDQNKEEIENYLKKHPEKQKINFNGEQMEDVKEAIDTKDSQTDSALFNYFKDKAFPYLSTKHLGVFPDHVID<br>MFINGYRLSLTNHGPTPVKDGTKDPRGGIFDAVFTRGDQTKLLTARHDFKEKTLNEISDLIKQELTEGKALGL<br>SHTYANVRINHVINLWGADFDSEGNLEAIYVTDSDSNASIGMKKYYVGVNAAGKVAISAKEIEDDNIGAQVLG<br>LFTLSTGQDIWEQTNLEHHHHHH (SEQ ID NO: 609) |
| PRT-555 | MANQEIRYSEETPKTITSVWTKGVTPPTDFIKNEDVLHAPYVANQGWYDITKTFNGKDDLLCGAATAGNMLHW<br>WFDQNKEEIERYLKKHPEKQKINFNGEQMEDVKEAIDTKDSQTDSKLFEYFKDKAFPYLSTKHLGVFPDHVID<br>MFINGYRLSLTNHGPTPVKRGTKDPRGGIFDAVFTRGDQSKLLTSRHDFKEKTLNEISDLIKQELQEGKALGL<br>SHTYANVRINHVINLWGADFDSEGNLEAIYVTDSDSNASIGMKKYYVGVNSAGKVAISAKEIEDDNIGAQVLG<br>LFTLSTGKDIWEQTNLEHHHHHH (SEQ ID NO: 610) |
| PRT-556 | MANQEIRYSKAKPKVITSVWTKGVTPPTQFTYNEDVFHAPYLPNQGWYDITKTFNGKDDLLCGAATAGNMLHW<br>WFDQNKEQIERYLKEHPEKQKINFNGEQMFDVKEAIDTKDSQTNSKLFNYFKDKAFPYLSTKHLGVFPDHVID<br>MFINGYRLSLINHGPTPVKEQNKDPRGGIFDDVFTRGDQSKLLTSRHDFKEKTLKEISDLIKQELKEGKALGL<br>SHTYANVRINHVINLWGADFDAEGNLVAIYVTDSDSNASIGMKKYYVGVNSAGKVAISAKEIEDDNIGAQVLG<br>LFTLSTGKDIWEKTNLEHHHHHH (SEQ ID NO: 611) |
| PRT-557 | MANQEIRYSEEDGKTITSVWTKGVTPPTDFQKNEDVYHAPYVANQGWYDITKTFNGKDDLLCGAATAGNMLHW<br>WFDQNKEEIERYLKKHPEKQKINFNGEQMEDVKEAIDTKDSQTDSALFEYFKDKAFPYLSTKHLGVFPDHVID<br>MFINGYRLSLTNHGPTPVKDGTKDPRGGIFDAVFTRGDQTKLLTERHDFKEKTLNEISDLIKQELQEGKALGL<br>SHTYANVRINHVINLWGADEDSEGNLEAIYVTDSDSNASIGMKKYYVGVNSAGKVAISAKEIEDDNIGAQVLG<br>LFTLSTGKDIWEQTNLEHHHHHH (SEQ ID NO: 612) |
| PRT-558 | MANQEIRYSEETPSTITSIWTKGVTPPTQFIQNEDVLHAPYIANQGWYDITKTFNGKDDLLCGAATAGNMLHW<br>WFDQNKTEIENYLTKHPEKQKINFNGEQMEDVKEAIDTKDSQTDSALFSYFKDKAFPYLSTKHLGVFPDHVID<br>MFINGYRLSLTNHGPTPVKRGTKDPRGGIFDAVFTRGDQTKLLTARHDFKEKTLNEISDLIKQELTEGKALGL<br>SHTYANVRINHVINLWGADENSEGNLEAIYVTDSDSNASIGMKKYYVGVNAAGKVAISAKEIEGDNIGAQVLG<br>LFTLSTGQDIWQQTNLEHHHHHH (SEQ ID NO: 613) |
| PRT-559 | MANQEIRYSEETPKTITSIWTKGVTPPTDFIKTEDVLHAPYVANQGWYDITKTFNGKDDLLCGAATAGNMLHW<br>WFDQNKEEIENYLKKHPEKQKINFNGEQMEDVKEAIDTKDSQTDSALFEYFKDKAFPYLSTKHLGVFPDHVID<br>MFINGYRLSLINHGPTPVKDGTKDPRGGIFDAVFTRGDQTKLLTERHDFKEKTLNEISDLIKQELTEGKALGL<br>SHTYANVRINHVINLWGADENSEGNLEAIYVTDSDSNASIGMKKYYVGVNAAGKVAISAKEIEDDNIGAQVLG<br>LFTLSTGQDIWEQTNLEHHHHHH (SEQ ID NO: 614) |
| PRT-560 | MANQEIRYSEETPKTITSVWTKGVTPPTDFIYNEDVLHAPYIANQGWYDITKTFNGKDDLLCGAATAGNMLHW<br>WFDQNKEQIERYLKKHPEKQKINFNGEQMFDVKEAIDTKDSQTDSALFEYFKDKAFPYLSTKHLGVFPDHVID<br>MFINGYRLSLINHGPTPVKRQTKDPRGGIFDAVFTRGDQSKLLTSRHDFKEKTLKEISDLIKQELTEGKALGL<br>SHTYANVRINHVINLWGADFDAEGNLEAIYVTDSDSNASIGMKKYYVGVNSAGKVAISAKEIEDDNIGAQVLG<br>LFTLSTGQDIWEQTNLEHHHHHH (SEQ ID NO: 615) |
| PRT-561 | MANQEIRYSEETPSTITSVWTKGVTPPTQFIYNEDVFHAPYIANQGWYDITKTFNGKDDLLCGAATAGNMLHW<br>WFDQNKEQIENYLKKHPEKQKINFNGEQMFDVKEAIDTKDSQTDSKLENYFKDKAFPYLSTKHLGVFPDHVID<br>MFINGYRLSLTNHGPTPVKRQTKDPRGGIFDAVETRGDQSKLLTSRHDFKEKTLNEISDLIKQELTEGKALGL<br>SHTYANVRINHVINLWGADFDAEGNLEAIYVTDSDSNASIGMKKYYVGVNSAGKVAISAKEIEDDNIGAQVLG<br>LFTLSTGQDIWQQTNLEHHHHHH (SEQ ID NO: 616) |
| PRT-562 | MANQEIRYSKATPSHITSVWTKGVTPPEQFIQNEDVLHAPYIANQGWYDITKTFNGKDDLLCGAATAGNMLHW<br>WFDQNKEQIENYLKKHPEKQKINFNGEQMFDVKEAIDTKDSQTNSALFSYFKDKAFPYLSTKHLGVFPDHVID<br>MFINGYRLSLTNHGPTPVKEQTKDPRGGIFDAVFTRGDQSKLLTSRHDFKEKTLNEISQLIKQELTEGKALGL<br>SHTYANVRINHVINLWGADFNAEGNLEAIYVTDSDSNASIGMKKYYVGVNSAGKVAISAKEIEDDNIGAQVLG<br>LFTLSTGQDIWQQTNLEHHHHHH (SEQ ID NO: 617) |

TABLE 5-continued

| ID | Polypeptide having protease activity Seq |
|---|---|
| PRT-563 | MANQEIRYSEATPSHITSVWTKGVTPPTQFIQNEDVLHAPYIANQGWYDITKTFNGKDDLLCGAATAGNMLHW<br>WFDQNKTQIENYLKKHPEKQKINFNGEQMFDVKEAIDTKDSQTDSALFSYFKDKAFPYLSTKHLGVFPDHVID<br>MFINGYRLSLTNHGPTPVKRQTKDPRGGIFDAVFTRGDQSKLLTARHDFKEKTLNEISQLIKQELTEGKALGL<br>SHTYANVRINHVINLWGADFNAEGNLEAIYVTDSDSNASIGMKKYYVGVNAAGKVAISAKEIEGDNIGAQVLG<br>LFTLSTGQDIWQQTNLEHHHHHH (SEQ ID NO: 618) |
| PRT-564 | MANQEIRYSEATPSHITSVWTKGVTPPTQFIQNEDVLHAPYIANQGWYDITKTFNGKDDLLCGAATAGNMLHW<br>WFDQNKTQIENYLKKHPEKQKINFNGEQMFDVKEAIDTKDSQTDSALFSYFKDKAFPYLSTKHLGVFPDHVID<br>MFINGYRLSLTNHGPTPVKRQTKDPRGGIFDAVFTRGDQSKLLTSRHDFKEKTLNEISQLIKQELTEGKALGL<br>SHTYANVRINHVINLWGADFNAEGNLEAIYVTDSDSNASIGMKKYYVGVNAAGKVAISAKEIEGDNIGAQVLG<br>LFTLSTGQDIWQQTNLEHHHHHH (SEQ ID NO: 619) |
| PRT-565 | MANQEIRYSEATPSHITSVWTKGVTPPTQFIQNEDVLHAPYIANQGWYDITKTFNGKDDLLCGAATAGNMLHW<br>WFDQNKEQIENYLKKHPEKQKINFNGEQMFDVKEAIDTKDSQTDSALFSYFKDKAFPYLSTKHLGVFPDHVID<br>MFINGYRLSLINHGPTPVKRQTKDPRGGIFDAVFTRGDQSKLLTSRHDFKEKTLNEISQLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWQQTNLEHHHHHH (SEQ ID NO: 620) |
| PRT-566 | MANQEIRYSEETPSTITSVWTKGVTPPTQFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADENAEGNLEAIYVTDSDSNASIGMKKYYVGVNSAGKVAISAKEIEGDNIGAQVLG<br>LFTLSTGQDIWNQTNLEHHHHHH (SEQ ID NO: 621) |
| PRT-567 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMFDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 622) |
| PRT-568 | MANQEIRYSEATPSHITSVWTKGVTPPTQFIQNEDVLHAPYIANQGWYDITKTFNGKDDLLCGAATAGNMLHW<br>WFDQNKTQIENYLKKHPEKQKINFNGEQMFDVKEAIDTKDSQTDSALFSYFKDKAFPYLSTKHLGVFPDHVID<br>MFINGYRLSLTNHGPTPVKRQTKDPRGGIFDAVETRGDQSKLLTARHDFKEKTLNEISQLIKQELTEGKALGL<br>SHTYANVRINHVINLWGADFNAEGNLEAIYVTDSDSNASIGMKKYYVGVNAAGHVAISAKEIEGDNIGAQVLG<br>LFTLSTGQDIWQQTNLEHHHHHH (SEQ ID NO: 623) |
| PRT-569 | MANQEIRYSKATPSHITSVWTKGVTPPEQFIYNEDVLHAPYIANQGWYDITKTFNGKDDLLCGAATAGNMLHW<br>WFDQNKEQIENYLKKHPEKQKINFNGEQMFDVKEAIDTKDSQTNSALFSYFKDKAFPYLSTKHLGVFPDHVID<br>MFINGYRLSLTNHGPTPVKEQTKDPRGGIFDAVFTRGDQSKLLTSRHDFKEKTLNEISQLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWQQTNLEHHHHHH (SEQ ID NO: 624) |
| PRT-570 | MANQEIRYSEATPSHITSVWTKGVTPPEQFIQNEDVLHAPYIANQGWYDITKTFNGKDDLLCGAATAGNMLHW<br>WFDQNKEQIEAYLKKHPEKQKINFNGEQMFDVKEAIDTKDSQTDSALFNYFKDKAFPYLSTKHLGVFPDHVID<br>MFINGYRLSLTNHGPTPVKEQTKDPRGGIFDAVFTRGDQSKLLTSRHDFKEKTLKEISQLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWQQTNLEHHHHHH (SEQ ID NO: 625) |
| PRT-571 | MANQEIRYSEETPSTITSVWTKGVTPPTQFIQNEDVLHAPYIANQGWYDITKTENGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADENAEGNLEAIYVTDSDSNASIGMKKYYVGVNAAGKVAISAKEIEGDNIGAQVLG<br>LFTLSTGQDIWNQTNLEHHHHHH (SEQ ID NO: 626) |
| PRT-572 | MANQEIRYSEATPSHITSVWTKGVTPPTQFIQNEDVLHAPYIANQGWYDITKTFNGKDDLLCGAATAGNMLHW<br>WFDQNKEQIENYLKKHPEKQKINFNGEQMFDVKEAIDTKDSQTDSALFSYFKDKAFPYLSTKHLGVFPDHVID<br>MFINGYRLSLTNHGPTPVKEQTKDPRGGIFDAVETRGDQSKLLTSRHDFKEKTLNEISQLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWQQTNLEHHHHHH (SEQ ID NO: 627) |
| PRT-573 | MANQEIRYSEETPSTITSVWTKGVTPPTQFIQNEDVLHAPYIANQGWYDITKTFNGKDDLLCGAATAGNMLHW<br>WFDQNKEQIENYLKKHPEKQKINFNGEQMFDVKEAIDTKDSQTDSALFSYFKDKAFPYLSTKHLGVFPDHVID<br>MFINGYRLSLTNHGPTPVKRQTKDPRGGIFDAVETRGDQSKLLTSRHDFKEKTLNEISQLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWQQTNLEHHHHHH (SEQ ID NO: 628) |
| PRT-574 | MANQEIRYSEETPKTITSVWTKGVTPPTDFIYNEDVLHAPYIANQGWYDITKTFNGKDDLLCGAATAGNMLHW<br>WFDQNKEQIERYLKKHPEKQKINFNGEQMEDVKEAIDTKDSQTNSKLFEYFKDKAFPYLSTKHLGVFPDHVID<br>MFINGYRLSLTNHGPTPVKEQTKDPRGGIFDAVFTRGDQSKLLTSRHDFKEKTLNEISDLIKQELTEGKALGL<br>SHTYANVRINHVINLWGADFDAEGNLEAIYVTDSDSNASIGMKKYYVGVNSAGKVAISAKEIEGDNIGAQVLG<br>LFTLSTGKDIWEQTNLEHHHHHH (SEQ ID NO: 629) |
| PRT-575 | MANQEIRYSEETPKTITSVWTKGVTPPTDFIYNEDVLHAPYIANQGWYDITKTFNGKDDLLCGAATAGNMLHW<br>WFDQNKEQIERYLKKHPEKQKINFNGEQMFDVKEAIDTKDSQTNSKLFEYFKDKAFPYLSTKHLGVFPDHVID<br>MFINGYRLSLTNHGPTPVKEQTKDPRGGIFDAVETRGDQSKLLTSRHDFKEKTLKEISDLIKQELTEGKALGL<br>SHTYANVRINHVINLWGADFDAEGNLEAIYVTDSDSNASIGMKKYYVGVNSAGKVAISAKEIEGDNIGAQVLG<br>LFTLSTGKDIWEQTNLEHHHHHH (SEQ ID NO: 630) |

TABLE 5-continued

| ID | Polypeptide having protease activity Seq |
|---|---|
| PRT-576 | MANQEIRYSKATPSTITSVWTKGVIPPENFIYNEDVLHAPYLANQGWYDITKTFNGKDDLLCGAATAGNMLHW WFDQNKEQIERYLKKHPEKQKINFNGEQMFDVKEAIDTKDSQTNSKLFEYFKDKAFPYLSTKHLGVFPDHVID MFINGYRLSLTNHGPTPVKEQTKDPRGGIFDAVETRGDQSKLLTSRHDFKEKTLNEISDLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWQQTNLEHHHHHH (SEQ ID NO: 631) |
| PRT-577 | MANQEIRYSKATPSTITSVWTKGVTPPENFIYNEDVLHAPYLANQGWYDITKTFNGKDDLLCGAATAGNMLHW WFDQNKEQIERYLKEHPEKQKINFNGEQMEDVKEAIDTKDSQTNSKLFEYFKDKAFPYLSTKHLGVFPDHVID MFINGYRLSLTNHGPTPVKEQTKDPRGGIFDAVFTRGDQSKLLTSRHDFKEKTLNEISQLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWQQTNLEHHHHHH (SEQ ID NO: 632) |
| PRT-578 | MANQEIRYSKATPKVITSVWTKGVTPPEDFTYNEDVFHAPYLPNQGWYDITKTFNGKDDLLCGAATAGNMLHW WFDQNKEQIERYLKEHPEKQKINFNGEQMFDVKEAIDTKDSQTNSKLFEYFKDKAFPYLSTKHLGVFPDHVID MFINGYRLSLTNHGPTPVKEQNKDPRGGIFDAVFTRGDQSKLLTSRHDFKEKTLKEISDLIKQELKEGKALGL SHTYANVRINHVINLWGADFDAEGNLEAIYVTDSDSNASIGMKKYYVGVNSAGKVAISAKEIEGDNIGAQVLG LFTLSTGKDIWEQTNLEHHHHHH (SEQ ID NO: 633) |
| PRT-579 | MANQEIRYSKATPSHITSVWTKGVTPPENFIYNEDVLHAPYLPNQGWYDITKTFNGKDDLLCGAATAGNMLHW WFDQNKEQIERYLKEHPEKQKINFNGEQMEDVKEAIDTKDSQTNSKLFEYFKDKAFPYLSTKHLGVFPDHVID MFINGYRLSLTNHGPTPVKEQNKDPRGGIFDAVETRGDQSKLLTSRHDFKEKTLNEISQLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWQQTNLEHHHHHH (SEQ ID NO: 634) |
| PRT-580 | MANQEIRYSEETPKTITSVWTKGVTPPTDFIKNEDVFHAPYVANQGWYDITKTFNGKDDLLCGAATAGNMLHW WFDQNKEEIERYLKKHPEKQKINFNGEQMFDVKEAIDTKDSQTNSKLFEYFKDKAFPYLSTKHLGVFPDHVID MFINGYRLSLTNHGPTPVKRGTKDPRGGIFDAVFTRGDQSKLLTSRHDFKEKTLKEISDLIKQELQEGKALGL SHTYANVRINHVINLWGADEDSEGNLEAIYVTDSDSNASIGMKKYYVGVNSAGKVAISAKEIEDDNIGAQVLG LFTLSTGKDIWEQTNLEHHHHHH (SEQ ID NO: 635) |
| PRT-581 | MANQEIRYSKATPKTITSVWTKGVIPPENFIYNEDVLHAPYLANQGWYDITKTFNGKDDLLCGAATAGNMLHW WFDQNKEQIERYLKEHPEKQKINFNGEQMEDVKEAIDTKDSQTNSKLFEYFKDKAFPYLSTKHLGVFPDHVID MFINGYRLSLTNHGPTPVKEQTKDPRGGIFDAVETRGDQSKLLTSRHDFKEKTLNEISDLIKQELTEGKALGL SHTYANVRINHVINLWGADFDAEGNLEAIYVTDSDSNASIGMKKYYVGVNSAGKVAISAKEIEGDNIGAQVLG LFTLSTGKDIWEQTNLEHHHHHH (SEQ ID NO: 636) |
| PRT-582 | MANQEIRYSKAKPKVITSVWTKGVTPPTQFTKNEDVFHAPYLANQGWYDITKTFNGKDDLLCGAATAGNMLHW WFDQNKEQIERYLKKHPEKQKINFNGEQMFDVKEAIDTKDSQTNSKLFNYFKDKAFPYLSTKHLGVFPDHVID MFINGYRLSLTNHGPTPVKEQNKDPRGGIFDDVFTRGDQSKLLTSRHDFKEKTLKEISDLIKQELKEGKALGL SHTYANVRINHVINLWGADEDAEGNLVAIYVTDSDSNASIGMKKYYVGVNSAGKVAISAKEIEDDNIGAQVLG LFTLSTGKDIWEKTNLEHHHHHH (SEQ ID NO: 637) |
| PRT-583 | MANQEIRYSKAKPKVITSVWTKGVTPPTQFTKNEDVFHAPYLANQGWYDITKTFNGKDDLLCGAATAGNMLHW WFDQNKEQIERYLKKHPEKQKINFNGEQMFDVKEAIDTKDSQTNSKLENYFKEKAFPYLSTKHLGVFPDHVID MFINGYRLSLINHGPTPVKEQNKDPRGGIFDDVFTRGDQSKLLTSRHDFKEKTLKEISDLIKQELKEGKALGL SHTYANVRINHVINLWGADFDAEGNLIAIYVTDSDSNASIGMKKYYVGVNSAGKVAISAKEIEDDNIGAQVLG LFTLSTGKDIWEKTNLEHHHHHH (SEQ ID NO: 638) |
| PRT-584 | MANQEIRYSEETPKTITSVWTKGVTPPTNFIYNEDVLHAPYIANQGWYDITKTFNGKDDLLCGAATAGNMLHW WFDQNKEQIERYLKKHPEKQKINFNGEQMEDVKEAIDTKDSQTNSKLFEYFKDKAFPYLSTKHLGVFPDHVID MFINGYRLSLTNHGPTPVKRQTKDPRGGIFDAVFTRGDQSKLLTSRHDFKEKTLNEISDLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWEQTNLEHHHHHH (SEQ ID NO: 639) |
| PRT-585 | MANQEIRYSKATPSTITSVWTKGVTPPEQFIYNEDVLHAPYIANQGWYDITKTFNGKDDLLCGAATAGNMLHW WFDQNKEQIERYLKKHPEKQKINFNGEQMEDVKEAIDTKDSQTNSKLFEYFKDKAFPYLSTKHLGVFPDHVID MFINGYRLSLTNHGPTPVKEQTKDPRGGIFDAVFTRGDQSKLLTSRHDFKEKTLNEISDLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWEQTNLEHHHHHH (SEQ ID NO: 640) |
| PRT-586 | MANQEIRYSEETPKTITSVWTKGVTPPTDFIYNEDVLHAPYIANQGWYDITKTFNGKDDLLCGAATAGNMLHW WFDQNKEQIERYLKKHPEKQKINFNGEQMFDVKEAIDTKDSQTDSKLFEYFKDKAFPYLSTKHLGVFPDHVID MFINGYRLSLTNHGPTPVKRGTKDPRGGIFDAVFTRGDQSKLLTSRHDFKEKTLNEISDLIKQELTEGKALGL SHTYANVRINHVINLWGADFNAEGNLEAIYVTDSDSNASIGMKKYYVGVNSAGKVAISAKEIEGDNIGAQVLG LFTLSTGQDIWEQTNLEHHHHHH (SEQ ID NO: 641) |
| PRT-587 | MANQEIRYSEETPKTITSVWTKGVTPPTDFIYNEDVLHAPYIANQGWYDITKTFNGKDDLLCGAATAGNMLHW WFDQNKEQIERYLKKHPEKQKINFNGEQMFDVKEAIDTKDSQTDSKLFEYFKDKAFPYLSTKHLGVFPDHVID MFINGYRLSLINHGPTPVKRGTKDPRGGIFDAVFTRGDQSKLLTSRHDFKEKTLNEISDLIKQELTEGKALGL SHTYANVRINHVINLWGADENSEGNLEAIYVTDSDSNASIGMKKYYVGVNSAGKVAISAKEIEGDNIGAQVLG LFTLSTGKDIWEQTNLEHHHHHH (SEQ ID NO: 642) |
| PRT-588 | MRNQTTTYSEVTPSHITSVWTKGVTPPEQFIQGEDVFHAPYIANQGWYDITKTFNGKDDLLCGAATAGNMLHW WFDQNKEQIENYLKKHPEKQKIMFNNEEMFDLREAINTKDSQTDSALFSYFKDKAFPNLSARRLGVMPDHVLD MFINGYYLNVGNTDKTDVNRGTKDLRGGIFDAVETRGDQSKLLTARHDLKNKTLKEISDLIKQELTEGKALAL SHTYANVRINHVINLWGADFDAEGNLEAIYVTDSDSNASIGMKKYYVGVNSAGKVAISAKKIEGDNIGAQVLG LFTLSTGQDIWQQTNLEHHHHHH (SEQ ID NO: 643) |

TABLE 5-continued

| ID | Polypeptide having protease activity Seq |
|---|---|
| PRT-589 | MRNQTTTYSEVTPSHITSVWTKGVTPPEQFIQGEDVFHAPYIANQGWYDITKTFNGKDDLLCGAATAGNMLHW<br>WFDQNKEQIENYLKKHPEKQKINENNEEMFDVREAINTKDSQTDSALFSYFKDKAFPYLSAKHLGVFPDHVID<br>MFINGYRLSLTNHDKTDVNRGTKDPRGGIFDAVFTRGDQSKLLTARHDFKNKTLKEISDLIKQELTEGKALGL<br>SHTYANVRINHVINLWGADFDAEGNLEAIYVTDSDSNASIGMKKYYVGVNSAGKVAISAKKIEGDNIGAQVLG<br>LFTLSTGQDIWQQTNLEHHHHHH (SEQ ID NO: 644) |
| PRT-590 | MANQEIRYSEETPSTVTSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 645) |
| PRT-591 | MANQEIRYSEETPSTITSVWTKGVTPPTDFIQNEDVLHAPYIANQGWYDITKTFNGKDDLLCGAATAGNMLHW<br>WFDQNKEQIKNYLKKHPEKQKINFNGEQMEDVKEAIDTKDSQTDSALFEYFKDKAFPYLSTKHLGVFPDHVID<br>MFINGYRLSLTNHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 646) |
| PRT-592 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKNSQTDSALFEYFKDKAFPYLSTKHLGVFPDHVID<br>MFINGYRLSLTNHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 647) |
| PRT-593 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMFDVKEAIDTKDHQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 648) |
| PRT-594 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQLDSALFEYFKDKAFPYLSTKHLGVFPDHVID<br>MFINGYRLSLTNHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 649) |
| PRT-595 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMFDVKEAIDTKDSQTDSALFEYFKDKAFPYLSTKHLGVFPDHVID<br>MFINGYRLSLTNHGPTPVKRGTKDPRGGIFDAVETRGDQSKLLTSRHDFKEKNLEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 650) |
| PRT-596 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLTNHGPTPVKRGTKDPRGGIFDAVFTRGDQSKLLTSRHDFKEKTLNEISDLIKKELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDIWNQTNLEHHHHHH (SEQ ID NO: 651) |
| PRT-597 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNANGNLEAIYVTDSDSNASIGMKKYYVGVNSAGKVAISAKEIEGDNIGAQVLG<br>LFTLSTGQDIWNQTNLEHHHHHH (SEQ ID NO: 652) |
| PRT-598 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYFVGVNSAGKVAISAKEIEGDNIGAQVLG<br>LFTLSTGQDIWNQTNLEHHHHHH (SEQ ID NO: 653) |
| PRT-599 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLTNHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIKGDNIGAQVLG<br>LFTLSTGQDIWNQTNLEHHHHHH (SEQ ID NO: 654) |
| PRT-600 | MANQEIRYSEETPSTITSVWTKGVTPPTDFIQNEDVLHAPYIANQGWYDITKTFNGKDDLLCGAATAGNMLHW<br>WFDQNKEQIENYLKKHPEKQKINFNGEQMEDVKEAIDTKDSQTDSALFEYFKDKAFPYLSTKHLGVFPDHVID<br>MFINGYRLSLINHGPTPVKRGTKDPRGGIFDAVFTRGDQSKLLTSRHDFKEKTLNEISDLIKQELTEGKALGL<br>SHTYANVRINHVINLWGADFNAEGNLEAIYVTDSDSNASIGMKKYYVGVNSAGKVAISAKEIEGDNIGAQVLG<br>LFTLSTGQDSWNQTNLEHHHHHH (SEQ ID NO: 655) |
| PRT-601 | MANQEIRYSEETPSTVTSVWTKGVTPPTDFIQNEDVLHAPYIANQGWYDITKTFNGKDDLLCGAATAGNMLHW<br>WFDQNKEQIKNYLKKHPEKQKINFNGEQMEDVKEAIDTKNHQLDSALFEYFKDKAFPYLSTKHLGVFPDHVID<br>MFINGYRLSLINHGPTPVKRGTKDPRGGIFDAVFTRGDQSKLLTSRHDFKEKNLEISDLIKKELTEGKALGL<br>SHTYANVRINHVINLWGADFNANGNLEAIYVTDSDSNASIGMKKYFVGVNSAGKVAISAKEIKGDNIGAQVLG<br>LFTLSTGQDSWNQTNLEHHHHHH (SEQ ID NO: 656) |

TABLE 5-continued

| ID | Polypeptide having protease activity Seq |
|---|---|
| PRT-602 | MANQEIRYSEVTPYHITSVWTKGVTPPANFTQGEDVFHAPYVANQGWYDITKTFNGKDDLLCGAATAGNMLHW<br>WFDQNKDQIERYLEEHPEKQKINFNGEQMEDVKEAIDTKDSQTDSKLFEYFKEKAFPYLSTKHLGVFPDHVID<br>MFINGYRLSLTNHGPTPVKEGSKDPRGGIFDAVFTRGDQSKLLTSRHDFKEKTLKEISDLIKQELTEGKALGL<br>SHTYANVRINHVINLWGADFDSEGNLKAIYVTDSDSNASIGMKKYYVGVNSAGKVAISAKEIEEDNIGAQVLG<br>LFTLSTGQDIWNQTNLEHHHHHH (SEQ ID NO: 657) |
| PRT-603 | MQITTVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNGGLNDISTIIKQELQSGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 658) |
| PRT-604 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDDVFGKGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 659) |
| PRT-605 | MQITSVWTKGVTPLTPEQFRYNNEDVIHAPYLAHQGWYDITKAFDGKDNLLCGAATAGNMLHWWFEQNKTEIE<br>AYLSKYGDTQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>EIWQKLSLEHHHHHH (SEQ ID NO: 660) |
| PRT-606 | MQITSVWTKGVTPLTPEQFRYNNEDVIHAPYLAHQGWYDITKAFDGKDNLLCGAATAGNMLHWWFDQNKTEIE<br>AYLSKYPDKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>EIWQKLSLEHHHHHH (SEQ ID NO: 661) |
| PRT-607 | MQITSVWTYGVKPLTPEQFRYNNEDVIHAPYLEHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 662) |
| PRT-608 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDADEKIGMKKYFVGINAHGHVAISAKKIEGENIGAQVLGLFTLSSGK<br>DIWQKLSLEHHHHHH (SEQ ID NO: 663) |
| PRT-609 | MQITSVWTKGVTPLTPEQFRYNNEDVIHAPYLAHQGWYDITKAFDRGDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDADEKIGMKKYFVGINAHGHVAISAKKIEGENIGAQVLGLFTLSSGK<br>DIWQKLSLEHHHHHH (SEQ ID NO: 664) |
| PRT-610 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYERDKAFPNLSARQLGVMPDLVLDMFINGYYLNV<br>FKTQSTDVNRPYQDKDKRGGIFDAVETRGDQTTLLTARHDLKNKGLNDISTIIKQELTEGRALALSHTYANVS<br>ISHVINLWGADFNAEGNLEAIYVTDSDANASIGMKKYYVGINAHGHVAISAYKIEGENIGAQVLGLFTLSSGK<br>DIWQKLSLEHHHHHH (SEQ ID NO: 665) |
| PRT-611 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARYDLYNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 666) |
| PRT-612 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLRAAINSKDSQTNSQLFNYFRDKAFPNLSARQLGVMPDLVLDMFINGYYLNV<br>FKTQSTDVNRPYQDKDKRGGIFDAVETRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 667) |
| PRT-613 | MQITTVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAISTKDSQTNSQLFNYFRDKAFPNLSARQLGVMPDLVLDMFINGYYLNV<br>FKTQSTDVNRPYQDKDKRGGIFDDVFTRGDQTTLLTARHDLKNGGLNDISTIIKQELTNGRALALSHTYANVS<br>ISHVINLWGADFNAEGNLEAIYVTDSDANARIGMKKYGVGINAHGHVAISAKKIEGENIGAQVLGLFTLSSGK<br>DIWQKLSLEHHHHHH (SEQ ID NO: 668) |
| PRT-614 | MQITSVWTKGVKPLTPEQFRYNNEDVIHAPYLAHQGWYDITKAFDGKDNLLCGAATAGNMLHWWFDQNKTEIE<br>AYLSKHPEKQKIIFNNQELFDLRAAIDTKDSQTNSQLFNYFRDKAFPNLSARQLGVMPDLVLDMFINGYYLNV<br>FKTQSTDVNRPYQDKDKRGGIFDDVFTRGDQTTLLTARHDLKNGGLNDISTIIKQELTEGRALALSHTYANVS<br>ISHVINLWGADFNAEGNLEAIYVIDSDANASIGMKKYKVGINAHGHVAISAKKIEGENIGAQVLGLFTLSSGK<br>DIWQKLSLEHHHHHH (SEQ ID NO: 669) |

TABLE 5-continued

| ID | Polypeptide having protease activity Seq |
|---|---|
| PRT-615 | MQITSVWTKGVTPLTPEQFRYNNEDVIHAPYLAHQGWYDITKAFDGKDNLLCGAATAGNMLHWWFDQNKTEIE<br>AYLSKYPEKQKIIFNNQELFDLRAAINTKDSQTNSQLFNYFRDKAFPNLSARQLGVMPDLVLDMFINGYYLNV<br>FKTQSTDVNRPYQDKDKRGGIFDAVENRGDQTTLLTARHDLKNKGLNDISTIIKQELSSGRALALSHTYANVS<br>ISHVINLWGADFNAEGNLEAIYVTDSDANSNIGMKKYKVGINAHGHVAISAKKIEGENIGAQVLGLFTLSSGK<br>DIWQKLSLEHHHHHH (SEQ ID NO: 670) |
| PRT-616 | MQITTVWTKGVTPLTPEQFRYNNEDVIHAPYLPHQGWYDITKAFDGKDNLLCGAATAGNMLHWWFDQNKTEIE<br>AYLSKYPEKQKIIFNNQELFDLRAAINTKDSQTNSQLFNYFRDKAFPNLSARQLGVMPDLVLDMFINGYYLNV<br>FKTQSTDVNRPYQDRDKRGGIFDAVENRGDQTTLLTARHDLKNKGLNDISTIIKQELSSGRALALSHTYANVS<br>ISHVINLWGADFNAEGNLEAIYVTDSDANASIGMKKYYVGINAHGHVAISAKKIEGENIGAQVLGLFTLSSGK<br>DIWQKLSLEHHHHHH (SEQ ID NO: 671) |
| PRT-617 | MQITSVWTKGVTPLTPEQFRYNNEDVIHAPYLPHQGWYDITKAFDGGDNLLCGAATAGNMLHWWFDQNKTEIE<br>AYLSKYPEKQKIIFNNQELFDLRAAINSKDSQTNSQLFNYFRDKAFPNLSARQLGVMPDLVLDMFINGYYLNV<br>FKTQSTDVNRPYQDPDKRGGIFDDVFKEGDQTTLLTARHDLKNGGLNDISTIIKQELQSGRALALSHTYANVS<br>ISHVINLWGADFNAEGNLEAIYVTDSDANQSIGMKKYKVGINAHGHVAISAKKIEGENIGAQVLGLFTLSSGK<br>EIWQKLSLEHHHHHH (SEQ ID NO: 672) |
| PRT-618 | MQITSVWTKGVIPLTPEQFRYNNEDVIHAPYLPHQGWYDITKAFDGGDNLLCGAATAGNMLHWWFDQNKTEIE<br>AYLSKYPEKQKIIFNNQELFDLRAAINTKDSQTNSQLFNYFRDKAFPNLSARQLGVMPDLVLDMFINGYYLNV<br>FKTQSTDVNRPYQDRDKRGGIFDHVFGRGDQTTLLTARHDLKNGGLNDISTIIKQELQSGRALALSHTYANVS<br>ISHVINLWGADFNAEGNLEAIYVTDSDANSSIGMKKYYVGINAHGHVAISAKKIEGENIGAQVLGLFTLSSGK<br>EIWQKLSLEHHHHHH (SEQ ID NO: 673) |
| PRT-619 | MQITTVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNGGLEDISTIIKQELKNGRALALSHTYANVS<br>ISHVINLWGADFNAEGNLSAIYVTDSDANASIGMKKYFVGINAHGHVAISAKKIEGENIGAQVLGLFTLSSGK<br>DIWQKLSLEHHHHHH (SEQ ID NO: 674) |
| PRT-620 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLTARHDLKNKTLKEISDIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 675) |
| PRT-621 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLTARHDLKNKTLNEISQIIKQELSSGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 676) |
| PRT-622 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLTARHDLKNKTLKEISDIIKQELQSGRALALSHTYANVS<br>ISHVINLWGADENSEGNLIAIYVTDSDANASIGMKKYFVGINAHGHVAISAKKIEGENIGAQVLGLFTLSSGK<br>DIWQKLSLEHHHHHH (SEQ ID NO: 677) |
| PRT-623 | MQITTVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNGTLNEISQIIKQELQSGRALALSHTYANVS<br>ISHVINLWGADFNAEGNLIAIYVTDSDANASIGMKKYFVGINAHGHVAISAKKIEGENIGAQVLGLFTLSSGK<br>DIWQKLSLEHHHHHH (SEQ ID NO: 678) |
| PRT-624 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRDYDDKDKRGGIFDDVFGKGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 679) |
| PRT-625 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPEDDKDKRGGIFDHVFTRGDQSTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 680) |
| PRT-626 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYERDKAFPNLSARQLGVMPDLVLDMFINGYYLNV<br>FKTQSTDVNRPPDDKDKRGGIFDHVFNRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 681) |
| PRT-627 | MQITSVWTKGVTPLTPEQFRYNNEDVIHAPYLAHQGWYDITKAFDGKDNLLCGAATAGNMLHWWFDQNKEEIE<br>AYLKKYGETQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLTARHDLKNKGLNDISTIIKQELTEGRALALSHTYANVS<br>ISHVINLWGADFNAEGNLEAIYVIDSDANASIGMKKYFVGINAHGHVAISAKKIEGENIGAQVLGLFTLSSGK<br>DIWQKLSLEHHHHHH (SEQ ID NO: 682) |

TABLE 5-continued

| ID | Polypeptide having protease activity Seq |
|---|---|
| PRT-628 | MQITSVWTKGVTPLTPEQFRYNNEDVIHAPYLAHQGWYDITKAFDGKDNLLCGAATAGNMLHWWFDQNKEEIE<br>AYLKKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGQ<br>DIWQQLSLEHHHHHH (SEQ ID NO: 683) |
| PRT-629 | MQITSVWTKGVTPLTPEQFRYNNEDVIHAPYLAHQGWYDITKAFDGKDNLLCGAATAGNMLHWWFDQNKEEIE<br>AYLKKYPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>EIWQKLSLEHHHHHH (SEQ ID NO: 684) |
| PRT-630 | MQITSVWTKGVTPLTPEQFRYNNEDVIHAPYLAHQGWYDITKAFDGKDNLLCGAATAGNMLHWWFDQNKEEIE<br>NYLKKYPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGQ<br>EIWEQLSLEHHHHHH (SEQ ID NO: 685) |
| PRT-631 | MQITSVWTKGVTPLTPEQFRYNNEDVIHAPYLAHQGWYDITKAFDGKDNLLCGAATAGNMLHWWFDQNKEEID<br>NYLKKYPDKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>EIWKKLSLEHHHHHH (SEQ ID NO: 686) |
| PRT-632 | MQITSVWTYGVTPLTPEQFRYNNYEVIHAPYKEGQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADENAEGNLEAIYVTDSDANASIGMKKYFVGINAHGHVAISAKKIEGENIGAQVLGLFTLSSGK<br>DIWQKLSLEHHHHHH (SEQ ID NO: 687) |
| PRT-633 | MQITSVWTKGVTPLTPEQFINNNEDVIHAPYKANQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLLTARHDLKNKGLNDISTIIKQELTEGKALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 688) |
| PRT-634 | MQITSVWTKGVTPLTPEQFRYNNYDVIHAPYKPNQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVETRGDQTTLLLTARHDLKNKGLNDISTIIKQELTEGKALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 689) |
| PRT-635 | MQITSVWTKGVTPLTPDQFTNQGEDVIHAPYTPNQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGKALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 690) |
| PRT-636 | MQITSVWTKGVTPLIMDQFRNYNYDVIHAPYKPGQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGKALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 691) |
| PRT-637 | MQITSVWTKGVTPLTPEQFRYNNEDVIHAPYLAHQGWYDITKAFDGGDGLLCGAATAGNMLHWWFDQNKTEIE<br>AYLSKHPEKQKIIFNNQELFDLKAAIDTKDSQTNSQLFNYFRDKAFPNLSARQKGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDAGNGIGMKKYFVGINAHGHVAISAKKIEGENIGAQVLGLFTLSSGK<br>DIWQKLSLEHHHHHH (SEQ ID NO: 692) |
| PRT-638 | MQITSVWTKGVTPLTPEQFRYNNEDVIHAPYLAHQGWYDITKLNDTGDGLLCGAATAGNMLHWWFDQNKTEIE<br>AYLSKHPEKQKIIFNNQELFDLKAAIDTKDSQTNSQLFNYFRDKAFPNLSARQKGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSNAGNGIGMKKYFVGINAHGHVAISAKKIEGENIGAQVLGLFTLSSGK<br>DIWQKLSLEHHHHHH (SEQ ID NO: 693) |
| PRT-639 | MQITSVWTKGVTPLTPEQFRYNNEDVIHAPYLAHQGWYDITKTFNGKDDLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDADASIGMKKYFVGINAHGHVAISAKKIEGENIGAQVLGLFTLSSGK<br>DIWQKLSLEHHHHHH (SEQ ID NO: 694) |
| PRT-640 | MQITSVWTKGVTPLTPEQFRYNNEDVIHAPYLAHQGWYDITKTFNGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYANVS<br>ISHVINLWGADFNAEGNLEAIYVTDSDADEKIGMKKYFVGINAHGHVAISAKKIEGENIGAQVLGLFTLSSGK<br>DIWQKLSLEHHHHHH (SEQ ID NO: 695) |

TABLE 5-continued

| ID | Polypeptide having protease activity Seq |
|---|---|
| PRT-641 | MQITSVWTKGVTPLTPEQFRYNNEDVIHAPYLAHQGWYDITKTMNGKDDLLCGAATAGNMLHWWFDQNKTEIE<br>AYLSKHPEKQKIIFNNQELFDLKAAIDTKDSQTNSQLFNYFRDKAFPNLSARQRGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDARENIGMKKYFVGINAHGHVAISAKKIEGENIGAQVLGLFTLSSGK<br>DIWQKLSLEHHHHHH (SEQ ID NO: 696) |
| PRT-642 | MQITSVWTKGVTPLTPEQFRYNNEDVIHAPYLAHQGWYDITKTFNRGDNLLCGAATAGNMLHWWFDQNKTEIE<br>AYLSKHPEKQKIIFNNQELFDLKAAIDTKDSQTNSQLFNYFRDKAFPNLSARQGGVMPDLVLDMFINGYYLNV<br>FKTQSTDVNRPYQDKDKRGGIFDAVETRGDQTTLLLTARHDLKNKGLNDISTIIKQELTEGRALALSHTYANVS<br>ISHVINLWGADFNAEGNLEAIYVTDSDADEKIGMKKYFVGINAHGHVAISAKKIEGENIGAQVLGLFTLSSGK<br>DIWQKLSLEHHHHHH (SEQ ID NO: 697) |
| PRT-643 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYERDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYKVGYNKDGRVAISAYKIEGENIGAQVLGLFTLSSGK<br>DIWQKLSLEHHHHHH (SEQ ID NO: 698) |
| PRT-644 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADFNAEGNLEAIYVTDSDANASIGMKKYYVGKNASGHVAISAKKIEDENIGAQVLGLFTLSSGK<br>DIWQKLSLEHHHHHH (SEQ ID NO: 699) |
| PRT-645 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTARHDLKNKGLNDISTIIKQELTEGRALALSHTYANVS<br>ISHVINLWGADENAEGNLEAIYVTDSDANASIGMKKYYVGYNKSGRVAISAYKITDENIGAQVLGLFTLSSGK<br>DIWQKLSLEHHHHHH (SEQ ID NO: 700) |
| PRT-646 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTETTDLYGKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 701) |
| PRT-647 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLTNRYDLYDKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 702) |
| PRT-648 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQYLFDLKAAIDTKDSQTNSQLFNYFRDKAFGNLSARQLGVMPDLVLDMFINGYYLNV<br>NKTQSTDVNRPYQKPDKRGGIFDAVFTRGDQTTLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 703) |
| PRT-649 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQYLFDLKAAIDTKDSQTNSQLFNYFRDKAFGNLSARQLGVMPDLVLDMFINGYKLKV<br>NKTQSTDVNRPYQKPDNFGGIFDAVETRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 704) |
| PRT-650 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQKLFDLKAAIDTKDSQTNSQLFNYFRDKAFPNLSARQLGVMPDLVLDMFINGYLNV<br>TKTQSTDVNRPYQTKDPRGGIFDAVFTRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 705) |
| PRT-651 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFGNLSARQLGVMPDLVLDMFINGYYLNV<br>GKTQSTDVNRPYQTRDKRGGIFDAVFTRGDQTTLLLTARHDLKNKGLNDISTIIKQELTEGRALALSHTYANVS<br>ISHVINLWGADFNAEGNLEAIYVTDSDANASIGMKKYFVGINAHGHVAISAKKIEGENIGAQVLGLFTLSSGK<br>DIWQKLSLEHHHHHH (SEQ ID NO: 706) |
| PRT-652 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYFRDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHGTANGG<br>YSHVINLWGADFNAEGNLEAIYVTDSDANASIGMKKYFVGINAHGHVAISAKKIEGENKGAQVLGLFTLSSGK<br>DIWQKLSLEHHHHHH (SEQ ID NO: 707) |
| PRT-653 | MQITSVWTKGVTPLTPEQFRYNNEDVIHAPYLAHQGWYDITKAFDGKDNLLCGAATAGNMLHWWFDQNKTEIE<br>AYLSKHPEKQKIIFNNQELFDLKAAIDTKDSQTNSQLFNYERDKAFPNLSARQLGVMPDLVLDMFINGYYLNV<br>FKTQSTDVNRPYQDKDKRGGIFDAVFTRGDQTTLLLTARHDLKNKGLNDISTIIKQELTEGRALALSHTYGNVR<br>SSHVINLWGADFNAEGNLEAIYVTDSDANASIGMKKYFVGINAHGHVAISAKKIEGENVGAQVLGLFTLSSGK<br>DIWQKLSLEHHHHHH (SEQ ID NO: 708) |

TABLE 5-continued

| ID | Polypeptide having protease activity Seq |
|---|---|
| PRT-654 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLKAAIDTKDSQTNSQLFNYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTTGNVS YSHVINLWGADFNAEGNLEAIYVTDSDANASIGMKKYFVGINAHGHVAISAKKIEGENVGAQVLGLFTLSSGK DIWQKLSLEHHHHHH (SEQ ID NO: 709) |
| PRT-655 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLKAAIDTKDSQTNSQLFNYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHKTGNGG SSHVINLWGADFNAEGNLEAIYVTDSDANASIGMKKYFVGINAHGHVAISAKKIEGEDVGAQVLGLFTLSSGK DIWQKLSLEHHHHHH (SEQ ID NO: 710) |
| PRT-656 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLKRAINDKDSQQNSELFNYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANASIGMKKYFVGINAHGHVAISAKKIEGENIGAQVLGLFTLSSGK DIWQKLSLEHHHHHH (SEQ ID NO: 711) |
| PRT-657 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLREAINTKDSQTDSKLFNYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANASIGMKKYFVGINAHGHVAISAKKIEGENIGAQVLGLFTLSSGK DIWQKLSLEHHHHHH (SEQ ID NO: 712) |
| PRT-658 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLRKAINTKDSQTNSALFNYERDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANASIGMKKYFVGINAHGHVAISAKKIEGENIGAQVLGLFTLSSGK DIWQKLSLEHHHHHH (SEQ ID NO: 713) |
| PRT-659 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLREAINTKDDQKDSKLFNYFREKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDANASIGMKKYFVGINAHGHVAISAKKIEGENIGAQVLGLFTLSSGK DIWQKLSLEHHHHHH (SEQ ID NO: 714) |
| PRT-660 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLRKAINTKDDQKESALFNYFRKKAFPNLSARQLGVMPDLVLDMFINGYYLNV FKTQSTDVNRPYQDKDKRGGIFDAVETRGDQTTLLTARHDLKNKGLNDISTIIKQELTEGRALALSHTYANVS ISHVINLWGADFNAEGNLEAIYVTDSDANASIGMKKYFVGINAHGHVAISAKKIEGENIGAQVLGLFTLSSGK DIWQKLSLEHHHHHH (SEQ ID NO: 715) |
| PRT-661 | MQITSVWTKGVTPLTPEQFRYNNEDVIHAPYLANQGWYDITKTFDGKDNLLCGAATAGNMLHWWFDQNKTEIE AYLSKHPEKQKIIFNNQELFDLKKAIDTKDSQTNSQLFNYFRDKAFPNLSARQLGVMPDLVLDMFINGYYLNV FKTQSTDVNRPYQDKDKRGGIFDAVFTRGDQTTLLTARHDLKNKGLNDISTIIKQELTEGRALALSHTYANVS ISHVINLWGADFNAEGNLEAIYVTDSDSNASIGMKKYFVGINAAGHVAISAKKIEGENIGAQVLGLFTLSSGK DIWQKLSLEHHHHHH (SEQ ID NO: 716) |
| PRT-662 | MQITSVWTKGVTPLTPEQFRYNNEDVIHAPYLAHQGWYDITKAFDGKDNLLCGAATAGNMLHWWFDQNKTEIE AYLSKHPEKQKIIFNNQELFDLRAAINTKDSQTNSQLFNYFRDKAFPNLSARQLGVMPDLVLDMFINGYYLNV FKTQSTDVNRPYQDKDKRGGIFDAVETRGDQTTLLTARHDLKNKGLNDISTLIKQELTEGRALALSHTYANVS ISHVINLWGADFNAEGNLEAIYVTDSDANASIGMKKYFVGINASGHVAISAKKIEGENIGAQVLGLFTLSSGK DIWQKLSLEHHHHHH (SEQ ID NO: 717) |
| PRT-663 | MQITSVWTKGVTPPTPEQFRYNNEDVIHAPYLAHQGWYDITKTFDGKDNLLCGAATAGNMLHWWFDQNKTEIE AYLSKHPEKQKIIFNNQELFDLKEAINTKDSQTNSQLFNYFRDKAFPNLSARQLGVMPDLVLDMFINGYYLNV FKTQSTDVNRPYQDKDKRGGIFDAVETRGDQTKLLTARHDLKNKGLNEISTLIKQELTEGKALALSHTYANVS ISHVINLWGADFNAEGNLEAIYVTDSDANASIGMKKYFVGINASGHVAISAKKIEGENIGAQVLGLFTLSTGK DIWQKLSLEHHHHHH (SEQ ID NO: 718) |
| PRT-664 | MQITSVWTKGVTPLTPEQFRYNNEDVIHAPYLPHQGWYDITKAFDGKDNLLCGAATAGNMLHWWFDQNKTEIE AYLSKHPEKQKIIFNNQELFDLRAAINTKDSQTNSALFNYERDKAFPNLSARQLGVMPDLVLDMFINGYYLNV FKTQSTDVNRPYQDKDKRGGIFDAVFTRGDQTTLLTARHDLKNKGLNDISTLIKQELTEGKALALSHTYANVS ISHVINLWGADFNAEGNLEAIYVTDSDSDASIGMKKYYVGINASGHVAISAKKIEGENIGAQVLGLFTLSSGK DIWQKLSLEHHHHHH (SEQ ID NO: 719) |
| PRT-665 | MQITSVWTKGVTPPTPEQFRYNNEDVIHAPYLAHQGWYDITKAFDGKDNLLCGAATAGNMLHWWFDQNKTEIE AYLSKYPEKQKIIFNNQELFDLRAAINTKDSQTNSQLFNYFRDKAFPNLSARQLGVMPDLVLDMFINGYYLNV FKTQSTDVNRPYQDKDKRGGIFDAVFTRGDQTTLLTARHDLSNKGLNDISTIIKQELTEGRALALSHTYANVS ISHVINLWGADFNAEGNLEAIYVTDSDSNASIGMKKYYVGINASGHVAISAKKIEGEVIGAQVLGLFTLSSGK EIWQKLSLEHHHHHH (SEQ ID NO: 720) |
| PRT-666 | MQITSVWTKGVTPPTPEQFRNNNEDVFHAPYLANQGWYDITKTFNGKDDLLCGAATAGNMLHWWFDQNKTEIE AYLKKHPEKQKIIFNNQELFDLKKAIDTKDSQTNSQLFNYFRDKAFPNLSARQLGVMPDLVLDMFINGYYLNV TKTQSTDVNRPYQDKDKRGGIFDAVETRGDQTTLLTSRHDLKNKGLNEISDLIKQELTEGKALALSHTYANVS INHVINLWGADFNAEGNLEAIYVTDSDSNASIGMKKYFVGVNASGKVAISAKKIEGENIGAQVLGLFTLSSGK DIWQKLSLEHHHHHH (SEQ ID NO: 721) |

TABLE 5-continued

| ID | Polypeptide having protease activity Seq |
|---|---|
| PRT-667 | MQITSVWTKGVTPLTPEQFRYNNEDVFHAPYLAHQGWYDITKAFNGKDNLLCGAATAGNMLHWWFDQNKEEIE<br>AYLKKHPEKQKIIFNNQELFDLRKAINTKDSQTNSQLFNYFRDKAFPNLSARQLGVMPDLVLDMFINGYYLNL<br>NKTQSTDVNRPYQDKDKRGGIFDHVFTRGDQTTLLTARHDLKNKTLNDISQLIKQELQEGKALALSHTYANVS<br>ISHVINLWGADFNAEGNLEAIYVTDSDSDASIGMKKYFVGKNASGHVAISAKKIEGENIGAQVLGLFTLSSGK<br>EIWQKLSLEHHHHHH (SEQ ID NO: 722) |
| PRT-668 | MQITSVWTKGVTPLTPEQFRYNNYDVFHAPYLAGQGWYDITKAFDGKDNLLCGAATAGNMLHWWFDQNKTEIE<br>AYLSKYPEKQKIIFNNQELFDLRKAINTKDSQTNSELFNYFRDKAFPNLSARQLGVMPDLVLDMFINGYYLNV<br>FKTQSTDVNRPYQDKDKRGGIFDAVFNRGDQTKLLTARHDLKNKGLNDISTLIKQELSSGRALALSHTTANVS<br>ISHVINLWGADFNAEGNLEAIYVTDSDDDSNIGMKKYKVGINASGHVAISAKKIEGENIGAQVLGLFTLSSGK<br>DIWQKLSLEHHHHHH (SEQ ID NO: 723) |
| PRT-669 | MQITSVWTKGVTPPTPEQFINNNEDVFHAPYLANQGWYDITKTFNGKDNLLCGAATAGNMLHWWFDQNKEQIE<br>AYLKKHPEKQKIIFNNQEMFDLKKAIDTKDSQTNSALFNYFRDKAFPNLSARQLGVMPDLVLDMFINGYYLNV<br>GKTQSTDVNRPYQTKDKRGGIFDAVFTRGDQTKLLTARHDLKNKGLNEISDLIKQELTEGKALALSHTYANVR<br>INHVINLWGADFNAEGNLIAIYVTDSDSNASIGMKKYFVGVNSAGKVAISAKKIEGDNIGAQVLGLFTLSSGQ<br>DIWQKLSLEHHHHHH (SEQ ID NO: 724) |
| PRT-670 | MQITSVWTKGVTPLTPEQFRNNNEDVFHAPYLPNQGWYDITKAFNGKDNLLCGAATAGNMLHWWFDQNKEEIE<br>AYLKKYPEKQKIIFNNQELFDLRKAINTKDSQTNSALFNYFRDKAFPNLSARQLGVMPDHVLDMFINGYYLNV<br>GKTQSTDVNRPYQDKDKRGGIFDHVFNRGDQTKLLTARHDLKNKTLNDISTLIKQELSSGKALALSHTYANVG<br>ISHVINLWGADFNAEGNLEAIYVTDSDDRASIGMKKYYVGRNASGHVAISAKKIEGENLGAQVLGLFTLSSGK<br>EIWQKLSLEHHHHHH (SEQ ID NO: 725) |
| PRT-671 | MQITTVWTKGVTPPTPEQFRNNNEDVFHAPYLPHQGWYDITKAFDGKDNLLCGAATAGNMLHWWFDQNKEEIE<br>AYLKKYPEKQKIIFNNQELFDLRKAINTKDSQTNSQLFNYFRDKAFPNLSARQLGVMPDHVLDMFINGYYLNV<br>FKTQSTDVNRPYQTRDKRGGIFDAVENRGDQTTLLTERHDLYNKGLDDISTLIKQELSSGKALGLSHTYANVS<br>ISHVINLWGADFNAEGNLEAIYVTDSDDDASIGMKKYYVGKNASGHVRISAKKIEGENIGAQVLGLFTLSTGK<br>DIWQKLSLEHHHHHH (SEQ ID NO: 726) |
| PRT-672 | MQITSVWTKGVTPPTPEQFTYQNEDVFHAPYIANQGWYDITKTFNGKDNLLCGAATAGNMLHWWFDQNKTEIE<br>NYLKKHPEKQKIIFNNQEMFDLRKAINTKDSQTNSALFEYFRDKAFPNLSARQLGVMPDHVLDMFINGYYLNV<br>TKTQSTDVNRPYQTKDKRGGIFDHVFTRGDQSKLLTARHDLKNKTLNEISDLIKQELTEGKALALSHTYANVR<br>INHVINLWGADFDAEGNLEAIYVTDSDSNASIGMKKYFVGVNSSGKVAISAKKIEDDNIGAQVLGLFTLSSGQ<br>DIWEQLSLEHHHHHH (SEQ ID NO: 727) |
| PRT-673 | MQITSVWTKGVTPPTPEQFRYNEDVLHAPYKPHQGWYDITKTFNGKDNLLCGAATAGNMLHWWFDQNKTQIE<br>AYLKKYPEKQKIIFNNQKMFDLRKAINTKDSQTNSALFSYFKDKAFPNLSARQRGVMPDLVLDMFINGYYLNV<br>GKTQSTDVNRPYQTRDKRGGIFDHVFGRGDQTKLLTARHDLKNKTLNEISQLIKQELSEGKALALSHTYANVS<br>ISHVINLWGADFNAEGNLEAIYVTDSDSDAKIGMKKYYVGKNASGKVAISAKKIEGENIGAQVLGLYTLSTGK<br>DIWQKLSLEHHHHHH (SEQ ID NO: 728) |
| PRT-674 | MQITSVWTKGVTPPTMEQFRYNNYDVFHAPYLPGQGWYDITKAFDGGDNLLCGAATAGNMLHWWFDQNKEEIE<br>AYLSKYPEKQKIIFNNQELFDLRKAINSKDSQTNSELFNYFRDKAFPNLSARQKGVMPDLVLDMFINGYYLNL<br>NKTQSTDVNRPYQDPDKRGGIFDDVFKEGDQTKLLTARHDLSNGGLDDISTIIKQELQSGRALALSHTYANVS<br>YSHVINLWGADFDAEGNLEAIYVTDSDDDQSIGMKKYKVGKNASGHVRISAKKIEDENIGAQVLGLFTLSLGK<br>EIWQKLSLEHHHHHH (SEQ ID NO: 729) |
| PRT-675 | MQITSVWTKGVTPPTMDDFTINGEDVFHAPYVANQGWYDITKTFNGKDDLLCGAATAGNMLHWWFDQNKEQIE<br>RYLKKHPEKQKIIFNNQEMFDLKEAINTKDSQTDSKLENYFRDKAFPNLSARQLGVMPDHVLDMFINGYYLNL<br>TKTQSTDVNRPEDTKDLRGGIFDHVFTRGDQSKLLTARHDLKNKTLKEISDLIKQELTEGKALGLSHTYANVR<br>ISHVINLWGADFDAEGNLEAIYVTDSDSNASIGMKKYYVGVNSAGKVAISAKKIEGDNIGAQVLGLYTLSTGK<br>DIWQKLSLEHHHHHH (SEQ ID NO: 730) |
| PRT-676 | MQITSVWTKGVTPPTMDQFTNYNYDVFHAPYKPGQGWYDITKTFDGKDNLLCGAATAGNMLHWWFDQNKEEIE<br>NYLKKHPEKQKIIFNNQKMFDLRKAINTKDSQTNSALFNYFKDKAFPNLSARQKGVMPDLVLDMFINGYYLNL<br>GKTQSTDVNREYQTKDSRGGIFDDVFGRGDQTKLLTARHDLYNGGLNDISQLIKQELSSGKALGLSHTYANVR<br>YSHVINLWGADFDEEGNLEAIYVTDSDDDASIGMKKYYVGKNASGKVAISAKKIEGENIGAQVLGLFTLSSGK<br>EIWQKLSLEHHHHHH (SEQ ID NO: 731) |
| PRT-677 | MQITSVWTKGVIPPTMDQFRYNNYDVFHAPYLPHQGWYDITKTFDGGDNLLCGAATAGNMLHWWFDQNKEYIE<br>NYLKKYPEKQKIIFNNQELFDLRKAINTKDSQTNSELFNYFRDKAFGNLSARQKGVMPDLVLDMFINGYYLNL<br>FKTQSTDVNRPNDTRDKRGGFFDHVFGRGDQTKLLTARHDLYNGGLSDISQLIKQELQSGKALAISHTYGNVS<br>SSHVINLWGADFDAEGNLEAIYVTDSDDRSSIGMKKYYVGINASGKVAISAKKIEGENVGAQVLGLFTLSSGK<br>EIWKKLSLEHHHHHH (SEQ ID NO: 732) |
| PRT-678 | MQITTVWTKGVTPLTPEQFRYNNEEVIHAPYKAGQGWYDITKVFDGKDNLLCGAATAGNMLHWWFDQNKTEIE<br>AYLSKHPEKQKIIFNNQELFDLKRAIDDKDSQTNSQLFNYFRDKAFPNLSARQLGVMPDLVLDMFINGYYLNV<br>FKTQSTDVNRPYQDPDKRGGIFDDVFGKGDQTTLLTARHDLKNLGLEDISTIIKQELRNGRALALSHTYANVS<br>ISHVINLWGADENAEGNLSAIYVTDSDANNSIGMKKYKVGYNAHGRVAISAKKIEGENIGAQVLGLFTLSSGK<br>DIWQKLSLEHHHHHH (SEQ ID NO: 733) |
| PRT-679 | MQITSVWTKGVTPLTPEQFRYNNEDVIHAPYLAHQGWYDITKTFDGKDNLLCGAATAGNMLHWWFDQNKTEIE<br>AYLSKHPEKQKIIFNNQELFDLKEAINTKDSQTNSQLFNYERDKAFPNLSARQLGVMPDLVLDMFINGYYLNV<br>FKTQSTDVNRPYQDKDKRGGIFDAVFTRGDQTTLLTARHDLKNKGLNEISTIIKQELTEGKALALSHTYANVS<br>ISHVINLWGADFNAEGNLEAIYVIDSDANASIGMKKYFVGINAHGHVAISAKKIEGENIGAQVLGLFTLSSGK<br>DIWQKLSLEHHHHHH (SEQ ID NO: 734) |

TABLE 5-continued

| ID | Polypeptide having protease activity Seq |
|---|---|
| PRT-680 | MQITSVWTKGVTPLTPEQFRYNNEDVIHAPYLPHQGWYDITKAFDGKDNLLCGAATAGNMLHWWFDQNKTEIE AYLSKHPEKQKIIFNNQELFDLRAAINTKDSQTNSALFNYFRDKAFPNLSARQLGVMPDLVLDMFINGYYLNV FKTQSTDVNRPYQDKDKRGGIFDAVETRGDQTTLLTARHDLKNKGLNDISTIIKQELTEGKALALSHTYANVS ISHVINLWGADFNAEGNLEAIYVTDSDANASIGMKKYYVGINAHGHVAISAKKIEGENIGAQVLGLFTLSSGK DIWQKLSLEHHHHHH (SEQ ID NO: 735) |
| PRT-681 | MQITSVWTKGVTPLTPEQFRYNNEDVIHAPYLAHQGWYDITKAFDGKDNLLCGAATAGNMLHWWFDQNKTEIE AYLSKYPEKQKIIFNNQELFDLRAAINTKDSQTNSQLFNYFRDKAFPNLSARQLGVMPDLVLDMFINGYYLNV FKTQSTDVNRPYQDKDKRGGIFDAVETRGDQTILLTARHDLKNKGLNDISTIIKQELTEGRALALSHTYANVS ISHVINLWGADFNAEGNLEAIYVIDSDANASIGMKKYYVGINAHGHVAISAKKIEGENIGAQVLGLFTLSSGK EIWQKLSLEHHHHHH (SEQ ID NO: 736) |
| PRT-682 | MQITSVWTKGVTPLTPEQFRNNNEDVIHAPYLANQGWYDITKTFNGKDNLLCGAATAGNMLHWWFDQNKTEIE AYLKKHPEKQKIIFNNQELFDLKKAIDTKDSQTNSQLFNYFRDKAFPNLSARQLGVMPDLVLDMFINGYYLNV FKTQSTDVNRPYQDKDKRGGIFDAVFTRGDQTTLLTSRHDLKNKGLNEISDIIKQELTEGKALALSHTYANVS ISHVINLWGADFNAEGNLEAIYVTDSDANASIGMKKYFVGVNAHGKVAISAKKIEGENIGAQVLGLFTLSSGK DIWQKLSLEHHHHHH (SEQ ID NO: 737) |
| PRT-683 | MQITSVWTKGVTPLTPEQFRYNNEDVIHAPYLAHQGWYDITKAFNGKDNLLCGAATAGNMLHWWFDQNKEEIE AYLKKHPEKQKIIFNNQELFDLRKAINTKDSQTNSQLFNYERDKAFPNLSARQLGVMPDLVLDMFINGYYLNV FKTQSTDVNRPYQDKDKRGGIFDHVFTRGDQTTLLTARHDLKNKTLNDISQIIKQELQEGKALALSHTYANVS ISHVINLWGADFNAEGNLEAIYVTDSDANASIGMKKYFVGVKNAHGHVAISAKKIEGENIGAQVLGLFTLSSGK EIWQKLSLEHHHHHH (SEQ ID NO: 738) |
| PRT-684 | MQITSVWTKGVTPLTPEQFTNNNEDVIHAPYLANQGWYDITKTENGKDNLLCGAATAGNMLHWWFDQNKEEIE AYLKKHPEKQKIIFNNQELFDLKKAIDTKDSQTNSALFNYFRDKAFPNLSARQLGVMPDLVLDMFINGYYLNV FKTQSTDVNRPYQTKDKRGGIFDAVFTRGDQTTLLTARHDLKNKGLNEISDIIKQELTEGKALALSHTYANVS ISHVINLWGADFNAEGNLIAIYVTDSDANASIGMKKYFVGVNSHGKVAISAKKIEGENIGAQVLGLFTLSSGQ DIWQKLSLEHHHHHH (SEQ ID NO: 739) |
| PRT-685 | MQITSVWTKGVTPLTPEQFRNNNEDVIHAPYLPNQGWYDITKAFNGKDNLLCGAATAGNMLHWWFDQNKEEIE AYLKKYPEKQKIIFNNQELFDLRKAINTKDSQTNSALFNYFRDKAFPNLSARQLGVMPDLVLDMFINGYYLNV FKTQSTDVNRPYQDKDKRGGIFDHVENRGDQTTLLTARHDLKNKILNDISTIIKQELSSGKALALSHTYANVS ISHVINLWGADFNAEGNLEAIYVTDSDANASIGMKKYYVGRNAHGHVAISAKKIEGENIGAQVLGLFTLSSGK EIWQKLSLEHHHHHH (SEQ ID NO: 740) |
| PRT-686 | MQITSVWTKGVTPLTPEQFTYNNEDVIHAPYIANQGWYDITKTFNGKDNLLCGAATAGNMLHWWFDQNKTEIE NYLKKHPEKQKIIFNNQELFDLRKAINTKDSQTNSALFNYFRDKAFPNLSARQLGVMPDLVLDMFINGYYLNV FKTQSTDVNRPYQTKDKRGGIFDHVFTRGDQSTLLTARHDLKNKTLNEISDIIKQELTEGKALALSHTYANVS ISHVINLWGADFNAEGNLEAIYVTDSDANASIGMKKYFVGVNSHGKVAISAKKIEDENIGAQVLGLFTLSSGQ DIWEQLSLEHHHHHH (SEQ ID NO: 741) |
| PRT-687 | MQITSVWTKGVTPLTPEQFRYNNEDVIHAPYKPHQGWYDITKTFNGKDNLLCGAATAGNMLHWWFDQNKTEIE AYLKKYPEKQKIIFNNQKLFDLRKAINTKDSQTNSALFNYFRDKAFPNLSARQLGVMPDLVLDMFINGYYLNV FKTQSTDVNRPYQTRDKRGGIFDHVFGRGDQTTLLTARHDLKNKTLNEISQIIKQELSEGKALALSHTYANVS ISHVINLWGADFNAEGNLEAIYVTDSDANAKIGMKKYYVGKNAHGKVAISAKKIEGENIGAQVLGLFTLSSGK DIWQKLSLEHHHHHH (SEQ ID NO: 742) |
| PRT-688 | MQITSVWTKGVTPLIMDDFTINNEDVIHAPYVANQGWYDITKTENGKDNLLCGAATAGNMLHWWFDQNKEEIE RYLKKHPEKQKIIFNNQELFDLKEAINTKDSQTDSKLENYFRDKAFPNLSARQLGVMPDLVLDMFINGYYLNV FKTQSTDVNRPYDTKDKRGGIFDHVFTRGDQSTLLTARHDLKNKTLKEISDIIKQELTEGKALALSHTYANVS ISHVINLWGADFNAEGNLEAIYVTDSDANASIGMKKYYVGVNSHGKVAISAKKIEGENIGAQVLGLFTLSSGK DIWQKLSLEHHHHHH (SEQ ID NO: 743) |
| PRT-689 | MQITSVWTKGVTPLTMDQFINNNEDVIHAPYKPGQGWYDITKTFDGKDNLLCGAATAGNMLHWWFDQNKEEIE NYLKKHPEKQKIIFNNQKLFDLRKAINTKDSQTNSALFNYFRDKAFPNLSARQLGVMPDLVLDMFINGYYLNV FKTQSTDVNREYQTKDKRGGIFDDVFGRGDQTTLLTARHDLKNGGLNDISQIIKQELSSGKALALSHTYANVS ISHVINLWGADFNEEGNLEAIYVTDSDANASIGMKKYYVGKNAHGKVAISAKKIEGENIGAQVLGLFTLSSGK EIWQKLSLEHHHHHH (SEQ ID NO: 744) |
| PRT-690 | MQITSVWTKGVTPPTPEQFRYNNEDVIHAPYLANQGWYDITKTFNGKDNLLCGAATAGNMLHWWFDQNKTEIE AYLSKYPEKQKIIFNNQELFDLRAAINTKDSQTNSQLFNYFRDKAFPNLSARQLGVMPDLVLDMFINGYYLNV FKTQSTDVNRPYQDKDKRGGIFDAVENRGDQTTLLTARHDLKNKTLNDISTLIKQELSSGKALALSHTYANVS ISHVINLWGADFNAEGNLEAIYVIDSDANSNIGMKKYKVGVNAHGKVAISAKKIEGENIGAQVLGLFTLSSGK DIWQKLSLEHHHHHH (SEQ ID NO: 745) |
| PRT-691 | MQITTVWTKGVTPPTPEQFRYNNEDVIHAPYLPNQGWYDITKTFNGKDNLLCGAATAGNMLHWWFDQNKTEIE AYLSKYPEKQKIIFNNQELFDLRAAINTKDSQTNSQLFNYFRDKAFPNLSARQLGVMPDLVLDMFINGYYLNV FKTQSTDVNRPYQDRDKRGGIFDAVENRGDQTTLLTARHDLKNKTLNDISTLIKQELSSGKALALSHTYANVS ISHVINLWGADFNAEGNLEAIYVTDSDANASIGMKKYYVGVNAHGKVAISAKKIEGENIGAQVLGLFTLSSGK DIWQKLSLEHHHHHH (SEQ ID NO: 746) |
| PRT-692 | MQITSVWTKGVTPPTPEQFRYNNEDVIHAPYLPNQGWYDITKTENGGDNLLCGAATAGNMLHWWFDQNKTEIE AYLSKYPEKQKIIFNNQELFDLRAAINSKDSQTNSQLFNYFRDKAFPNLSARQLGVMPDLVLDMFINGYYLNV FKTQSTDVNRPYQDPDKRGGIFDDVFKEGDQTTLLTARHDLKNGTLNDISTLIKQELQSGKALALSHTYANVS ISHVINLWGADFNAEGNLEAIYVTDSDANQSIGMKKYKVGVNAHGKVAISAKKIEGENIGAQVLGLFTLSSGK EIWQKLSLEHHHHHH (SEQ ID NO: 747) |

TABLE 5-continued

| ID | Polypeptide having protease activity Seq |
|---|---|
| PRT-693 | MQITSVWTKGVIPPTPEQFRYNNEDVIHAPYLPNQGWYDITKTENGGDNLLCGAATAGNMLHWWFDQNKTEIE<br>AYLSKYPEKQKIIFNNQELFDLRAAINTKDSQTNSQLFNYFRDKAFPNLSARQLGVMPDLVLDMFINGYYLNV<br>FKTQSTDVNRPYQDRDKRGGIFDHVFGRGDQTTLLTARHDLKNGTLNDISTLIKQELQSGKALALSHTYANVS<br>ISHVINLWGADFNAEGNLEAIYVTDSDANSSIGMKKYYVGVNAHGKVAISAKKIEGENIGAQVLGLFTLSSGK<br>EIWQKLSLEHHHHHH (SEQ ID NO: 748) |
| PRT-694 | MTITSVWTKGVTPPTPEDFRYNNEDVLHAPYVANQGWYDITKTFDGKDNLLCGAATAGNMLHWWFDQNKEEIE<br>RYLKKYPEKQKIIFNNQELFDVRAAINTKDSQTNSKLFNYFRDKAFPNLSARQLGVMPDLVLDMFINGYYLNL<br>GKTQSTDVNRPYQDKDKRGGIFDAVFNRGDQTTLLTARHDLKNKGLNEISDLIKQELSSGKALALSHTYANVR<br>INHVINLWGADFDAEGNLIAIYVTDSDANSNIGMKKYKVGVNANGKVAISAKKIEGDNIGAQVLGLFTLSTGQ<br>DIWQKLSLEHHHHHH (SEQ ID NO: 749) |
| PRT-695 | MTITTVWTKGVTPPTPEDFRYNNEDVLHAPYVPNQGWYDITKTFDGKDNLLCGAATAGNMLHWWFDQNKEEIE<br>RYLKKYPEKQKIIFNNQELFDVRAAINTKDSQTNSKLFNYFRDKAFPNLSARQLGVMPDLVLDMFINGYYLNL<br>GKTQSTDVNRPYQDRDKRGGIFDAVENRGDQTTLLTARHDLKNKGLNEISDLIKQELSSGKALALSHTYANVR<br>INHVINLWGADFDAEGNLIAIYVTDSDANASIGMKKYYVGVNANGKVAISAKKIEGDNIGAQVLGLFTLSTGQ<br>DIWQKLSLEHHHHHH (SEQ ID NO: 750) |
| PRT-696 | MTITSVWTKGVTPPTPEDFRYNNEDVLHAPYVPNQGWYDITKTFDGGDNLLCGAATAGNMLHWWFDQNKEEIE<br>RYLKKYPEKQKIIFNNQELFDVRAAINSKDSQTNSKLENYFRDKAFPNLSARQLGVMPDLVLDMFINGYYLNL<br>GKTQSTDVNRPYQDPDKRGGIFDDVFKEGDQTTLLTARHDLKNGGLNEISDLIKQELQSGKALALSHTYANVR<br>INHVINLWGADFDAEGNLIAIYVTDSDANQSIGMKKYKVGVNANGKVAISAKKIEGDNIGAQVLGLFTLSTGQ<br>EIWQKLSLEHHHHHH (SEQ ID NO: 751) |
| PRT-697 | MTITSVWTKGVIPPTPEDFRYNNEDVLHAPYVPNQGWYDITKTFDGGDNLLCGAATAGNMLHWWFDQNKEEIE<br>RYLKKYPEKQKIIFNNQELFDVRAAINTKDSQTNSKLFNYFRDKAFPNLSARQLGVMPDLVLDMFINGYYLNL<br>GKTQSTDVNRPYQDRDKRGGIFDHVFGRGDQTTLLTARHDLKNGGLNEISDLIKQELQSGKALALSHTYANVR<br>INHVINLWGADFDAEGNLIAIYVTDSDANSSIGMKKYYVGVNANGKVAISAKKIEGDNIGAQVLGLFTLSTGQ<br>EIWQKLSLEHHHHHH (SEQ ID NO: 752) |
| PRT-698 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRINHVINL<br>WGADFDAEGNLEAIYVTDSDSNPSIGMKKYFVGVNSSGKVAISAKEIEEDNIGAQVLGLFTLSTGQDIWQQTN<br>(SEQ ID NO: 1290) |
| PRT-699 | VTSVWTKGVTPPTDFIYGEDVLHAPYKAGQGWYDITKLFNGKDDLLCGAATAGNMLHWWFDQNKEQIKNYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLINRYDLKEKTLKEISDLIKQELTEGKALGISHTYANVRINHVINL<br>WGADFDAEGNLEAIYVTDSDSNPSIGMKKYFVGVNSSGKVAISAKEIEEDNIGAQVLGLFTLSTGQDIWNQTN<br>(SEQ ID NO: 1291) |
| PRT-700 | VTSVWTKGVTPPTDFIYGEDVLHAPYKAGQGWYDITKLFNGKDDLLCGAATAGNMLHWWFDQNKEQIKNYLKK<br>YPEKQKINFGGEQLFDVKEAIDTKDSQLDSKLFDYFKEKAFPYLSTKHLGVFPDHVIDMFINGYRLSLTDHGP<br>TPVKRGSKDPRGGIFDAVETRGDQSKLLTNRYDLKEKTLKEISDLIKQELTEGKALGISHTYANVRINHVINL<br>WGADFDAEGNLEAIYVTDSDSNPSIGMKKYFVGVNSSGKVAISAKEIEEDNIGAQVLGLFTLSTGQDIWNQIN<br>(SEQ ID NO: 1292) |
| PRT-701 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRINHVINL<br>WGADFDAEGNLEAIYVTNSDSNPSIGMKKYFVGVNSSGKVAISAKEIEEDNIGAQVLGLFTLSTGQDIWQQTN<br>(SEQ ID NO: 1293) |
| PRT-702 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRINHVINL<br>WGADFDAEGNLEAIYVTDSDSNSPSIGMKKYFVGVNSSGKVAISAKEIEEDNIGAQVLGLFTLSTGQDIWQQTN<br>(SEQ ID NO: 1294) |
| PRT-703 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTDSDSNPSIGMKKYFVGVNSSGKVAISAKEIEEDNIGAQVLGLFTLSTGQDIWQQTN<br>(SEQ ID NO: 1295) |
| PRT-704 | VTSVWTKGVTPPTDFIYGEDVLHAPYKAGQGWYDITKLFNGKDDLLCGAATAGNMLHWWFDQNKEQIKNYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTDSDSNPSIGMKKYFVGVNSSGKVAISAKEIEEDNIGAQVLGLFTLSTGQDIWNQTN<br>(SEQ ID NO: 1296) |
| PRT-705 | VTSVWTKGVTPPTDFIYGEDVLHAPYKAGQGWYDITKLFNGKDDLLCGAATAGNMLHWWFDQNKEQIKNYLKK<br>YPEKQKINFGGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTDSDSNPSIGMKKYFVGVNSSGKVAISAKEIEEDNIGAQVLGLFTLSTGQDIWNQTN<br>(SEQ ID NO: 1297) |

TABLE 5-continued

| ID | Polypeptide having protease activity Seq |
|---|---|
| PRT-706 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTNSDSNPSIGMKKYFVGVNSSGKVAISAKEIEEDNIGAQVLGLFTLSTGQDIWQQTN<br>(SEQ ID NO: 1298) |
| PRT-707 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLINRYDLKEKTLKEISDLIKQELTEGKALGISHTYANGRINHVINL<br>WGADFDAEGNLEAIYVTNSNSNPSIGMKKYFVGVNSSGKVAISAKEIEEDNIGAQVLGLFTLSTGQDIWQQTN<br>(SEQ ID NO: 1299) |
| PRT-708 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLINRYDLKEKTLKEISDLIKQELTEGKALGISHTYANVRINHVINL<br>WGADFDAEGNLEAIYVINSDSNPSIGMKKYFVGVNSSGKVAISAKEIEEDNIGAQVLGLFTLSTGQDIWQQTN<br>(SEQ ID NO: 1300) |
| PRT-709 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRINHVINL<br>WGADFDAEGNLEAIYVTDSNSNPSIGMKKYFVGVNSSGKVAISAKEIEEDNIGAQVLGLFTLSTGQDIWQQTN<br>(SEQ ID NO: 1301) |
| PRT-710 | VTSVWTKGVTPPTDFIYGEDVLHAPYKAGQGWYDITKLFNGKDDLLCGAATAGNMLHWWFDQNKEQIKNYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVTDSDSNPSIGMKKYFVGVNSSGKVAISAKEIEEDNIGAQVLGLFTLSTGQDIWNQTN<br>(SEQ ID NO: 1302) |
| PRT-711 | VTSVWTKGVTPPTDFIYGEDVLHAPYKAGQGWYDITKLFNGKDDLLCGAATAGNMLHWWFDQNKEQIKNYLKK<br>YPEKQKINFGGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLLTNRYDLKEKTLKEISDLIKQELTEGKALGISHTYANVRIGHVINL<br>WGADFDAEGNLEAIYVTDSDSNPSIGMKKYFVGVNSSGKVAISAKEIEEDNIGAQVLGLFTLSTGQDIWNQTN<br>(SEQ ID NO: 1303) |
| PRT-712 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVTNSDSNPSIGMKKYFVGVNSSGKVAISAKEIEEDNIGAQVLGLFTLSTGQDIWQQTN<br>(SEQ ID NO: 1304) |
| PRT-713 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVTDSNSNPSIGMKKYFVGVNSSGKVAISAKEIEEDNIGAQVLGLFTLSTGQDIWQQTN<br>(SEQ ID NO: 1305) |
| PRT-714 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVINSDSNPSIGMKKYFVGVNSSGKVAISAKEIEEDNIGAQVLGLFTLSTGQDIWQQTN<br>(SEQ ID NO: 1306) |
| PRT-715 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVTDSNSNPSIGMKKYFVGVNSSGKVAISAKEIEEDNIGAQVLGLFTLSTGQDIWQQTN<br>(SEQ ID NO: 1307) |
| PRT-716 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTNSDSNPSIGMKKYFVGVNSSGKVAISAKEIEEDNIGAQVLGLFTLSTGQDIWQQTN<br>(SEQ ID NO: 1308) |
| PRT-717 | VTSVWTKGVTPPTDFIYGEDVLHAPYKAGQGWYDITKLFNGKDDLLCGAATAGNMLHWWFDQNKEQIENYLKK<br>YPEKQKINFNGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANGRINHVINL<br>WGADFDAEGNLEAIYVTDSNSNPSIGMKKYFVGVNSSGKVAISAKEIEEDNIGAQVLGLFTLSTGQDIWQQTN<br>(SEQ ID NO: 1309) |
| PRT-718 | VTSVWTKGVTPPTDFIYGEDVLHAPYKAGQGWYDITKLFNGKDDLLCGAATAGNMLHWWFDQNKEQIENYLKK<br>YPEKQKINFKGEQLFDVKEAIDTKDSQLDSKLFDYFKEKAFPYLSTKHLGVFPDHVIDMFINGYRLSLTDHGP<br>TPVKRGSKDPRGGIFDAVFTRGDQSKLLTNRYDLKEKTLKEISDLIKQELTEGKALGISHTYANVRIGHVINL<br>WGADFDAEGNLEAIYVTDSDSNPSIGMKKYFVGVNSSGKVAISAKEIEEDNIGAQVLGLFTLSTGQDIWQQTN<br>(SEQ ID NO: 1310) |

TABLE 5-continued

| ID | Polypeptide having protease activity Seq |
|---|---|
| PRT-719 | TITSVWTKGVTPPTPEDFRENNEDVLHAPYLANQGWYDITKAFDGKDNLLCGAATAGNMLHWWFDQNKEEIER YLKKHPEKQKIIFGNQELFDVKAAIDTKDSQTNSKLFDYFRDKAFPNLSARQLGVFPDLVLDMFINGYYLNGG KTQSTDVNRPYQDKDKRGGIFDAVFTRGDQTTLLTARHDLKNKGLNEISDLIKQELTEGKALALSHTYANVRI NHVINLWGADFDAEGNLEAIYVTDSDANPSIGMKKYFVGVNAHGKVAISAKKIEGDNIGAQVLGLFTLSTGQD QWQKLS (SEQ ID NO: 1333) |

In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 55-1019, 1290-1310 and 1333. Additional support for specific embodiments of proteases having an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 55-1019, 1290-1310 and 1333 may be found in U.S. Provisional Application No. 63/478,789, filed Jan. 6, 2023, U.S. Provisional Application No. 63/483,142, filed Feb. 3, 2023, U.S. Provisional Application No. 63/493,142, filed Mar. 31, 2023, U.S. Provisional Application No. 63/506,539, filed Jun. 6, 2023, and/or U.S. Provisional Application No. 63/600,157, filed Nov. 17, 2023, each of which is hereby incorporated by reference in its entirety.

In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1290. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1291. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1292. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1293. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1294. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1295. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1296. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1297. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1298. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1299. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1300. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1301. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1302. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1303. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1304. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1305. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1306. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1307. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1308. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1309. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1310. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of SEQ ID NO: 1333.

In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of any one of SEQ ID NO: 56-752, and optionally does not comprise the methionine (M) residue at the N-terminus of any one of SEQ ID NO: 56-752. For example, the protease having an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of any one of SEQ ID NO: 56-752, and optionally not comprising the methionine (M) residue at the N-terminus of any one of SEQ ID NO: 56-752, comprises the amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of any one of SEQ ID NO: 56-752, wherein the amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to the amino acid sequence of any one of SEQ ID NO: 56-752 does not comprise the methionine (M) residue at the N-terminus.

In some embodiments, the protease has an amino acid sequence selected from SEQ ID NO: 55-1019, 1290-1310 and 1333. In some embodiments, the protease has an amino acid sequence of SEQ ID NO: 56. In some embodiments, the protease has an amino acid sequence of SEQ ID NO: 57. In some embodiments, the protease has an amino acid sequence of SEQ ID NO: 58. In some embodiments, the protease has an amino acid sequence of SEQ ID NO: 59. In some embodiments, the protease has an amino acid sequence of SEQ ID NO: 60. In some embodiments, the protease has an amino acid sequence of SEQ ID NO: 61. In some embodiments, the protease has an amino acid sequence of SEQ ID NO: 62. In some embodiments, the protease has an amino acid sequence of SEQ ID NO: 63. In some embodiments, the protease has an amino acid sequence of SEQ ID NO: 64. In some embodiments, the protease has an amino acid sequence of SEQ ID NO: 65. In some embodiments, the protease has an amino acid sequence of SEQ ID NO: 66. In some embodiments, the protease has an amino acid sequence of SEQ ID NO: 67. In some embodiments, the protease has an amino acid sequence of SEQ ID NO: 68. In some embodiments, the protease has an amino acid sequence of SEQ ID NO: 69. In some embodiments, the protease has an amino acid sequence of SEQ ID NO: 70. In some embodiments, the protease has an amino acid sequence of SEQ ID NO: 71. In some embodiments, the protease has an amino acid sequence of SEQ ID NO: 72. In some embodiments, the protease has an amino acid sequence of SEQ ID NO: 73. In some embodiments, the protease has an amino acid sequence of SEQ ID NO: 74. In some embodiments, the protease has an amino acid sequence of SEQ ID NO: 75. In some embodiments, the protease has an amino acid sequence of SEQ ID NO: 76. In some embodiments, the protease has an amino acid sequence of SEQ ID NO: 77. In some embodiments, the protease has an amino acid sequence of SEQ ID NO: 78. In some embodiments, the protease has an amino acid sequence of SEQ ID NO: 79. In some embodiments, the protease has an amino acid sequence of SEQ ID NO: 80. In some embodiments, the protease has an amino acid sequence of SEQ ID NO: 81. In some embodiments, the protease has an amino acid sequence of SEQ ID NO: 82. In some embodiments, the protease has an amino acid sequence of SEQ ID NO: 83. In some embodiments, the protease has an amino acid sequence of SEQ ID NO: 84. In some embodiments, the protease has an amino acid sequence of SEQ ID NO: 85. In some embodiments, the protease has an amino acid sequence of SEQ ID NO: 86. In some embodiments, the protease has an amino acid sequence of SEQ ID NO: 87. In some embodiments, the protease has an amino acid sequence of SEQ ID NO: 88. In some embodiments, the protease has an amino acid sequence of SEQ ID NO: 89. In some embodiments, the protease has an amino acid sequence of SEQ ID NO: 90. In some embodiments, the protease has an amino acid sequence of SEQ ID NO: 91. In some embodiments, the protease has an amino acid sequence of SEQ ID NO: 92. In some embodiments, the protease has an amino acid sequence of SEQ ID NO: 93. In some embodiments, the protease has an amino acid sequence of SEQ ID NO: 94. In some embodiments, the protease has an amino acid sequence of SEQ ID NO: 95. In some embodiments, the protease has an amino acid sequence of SEQ ID NO: 96. In some embodiments, the protease has an amino acid sequence of SEQ ID NO: 97. In some embodiments, the protease has an amino acid sequence of SEQ ID NO: 98. In some embodiments, the protease has an amino acid sequence of SEQ ID NO: 99. In some embodiments, the protease has an amino acid sequence of SEQ ID NO: 100. In some embodiments, the protease has an amino acid sequence of SEQ ID NO: 101. In some embodiments, the protease has an amino acid sequence of SEQ ID NO: 102. In some embodiments, the protease has an amino acid sequence of SEQ ID NO: 103. In some embodiments, the protease has an amino acid sequence of SEQ ID NO: 104. In some embodiments, the protease has an amino acid sequence of SEQ ID NO: 105. In some embodiments, the protease has an amino acid sequence of SEQ ID NO: 106. In some embodiments, the protease has an amino acid sequence of SEQ ID NO: 107. In some embodiments, the protease has an amino acid sequence of SEQ ID NO: 108. In some embodiments, the protease has an amino acid sequence of SEQ ID NO: 109. In some embodiments, the protease has an amino acid sequence of SEQ ID NO: 110. In some embodiments, the protease has an amino acid sequence of SEQ ID NO: 111. In some embodiments, the protease has an amino acid sequence of SEQ ID NO: 112. In some embodiments, the protease has an amino acid sequence of SEQ ID NO: 113. In some embodiments, the protease has an amino acid sequence of SEQ ID NO: 114. In some embodiments, the protease has an amino acid sequence of SEQ ID NO: 115. In some embodiments, the protease has an amino acid sequence of SEQ ID NO: 116. In some embodiments, the protease has an amino acid sequence of SEQ ID NO: 117. In some embodiments, the protease has an amino acid sequence of SEQ ID NO: 118. In some embodiments, the protease has an amino acid sequence of SEQ ID NO: 119. In some embodiments, the protease has an amino acid sequence of SEQ ID NO: 120. In some embodiments, the protease has an amino acid sequence of SEQ ID NO: 121. In some embodiments, the protease has an amino acid sequence of SEQ ID NO: 122. In some embodiments, the protease has an amino acid sequence of SEQ ID NO: 123. In some embodiments, the protease has an amino acid sequence of SEQ ID NO: 124. In some embodiments, the protease has an amino acid sequence of SEQ ID NO: 125. In some embodiments, the protease has an amino acid sequence of SEQ ID NO: 126. In some embodiments, the protease has an amino acid sequence of SEQ ID NO: 127. In some embodiments, the protease has an amino acid sequence of SEQ ID NO: 128. In some embodiments, the protease has an amino acid sequence of SEQ ID NO: 129. In some embodiments, the protease has an amino acid sequence of SEQ ID NO: 130. In some embodiments, the protease has an amino acid sequence of SEQ ID NO: 131. In some embodiments, the protease has an amino acid sequence of SEQ ID NO: 132. In some embodiments, the protease has an amino acid sequence of SEQ ID NO: 133. In some embodiments, the protease has an amino acid sequence of SEQ ID NO: 134. In some embodiments, the protease has an amino acid sequence of SEQ ID NO: 135. In some embodiments, the protease has an amino acid sequence of SEQ ID NO: 136. In some embodiments, the protease has an amino acid sequence of SEQ ID NO: 137. In some embodiments, the protease has an amino acid sequence of SEQ ID NO: 138. In some embodiments, the protease has an amino acid sequence of SEQ ID NO: 139. In some embodiments, the protease has an amino acid sequence of SEQ ID NO: 140. In some embodiments, the protease has an amino acid sequence of SEQ ID NO: 141. In some embodiments, the protease has an amino acid sequence of SEQ ID NO: 142. In some embodiments, the protease has an amino acid sequence of SEQ ID NO: 143. In some embodiments, the protease has an amino acid sequence of SEQ ID NO: 144. In some embodiments, the protease has an amino acid sequence of SEQ ID NO: 145. In some embodiments, the protease has an amino acid sequence of SEQ ID NO: 146. In some embodiments, the protease has an amino acid sequence of SEQ ID NO: 147. In some embodiments, the protease has an amino acid sequence of SEQ ID NO: 148. In some embodiments, the protease has an amino acid sequence of SEQ ID NO: 149. In some embodiments, the protease has an amino acid sequence of SEQ ID NO: 150. In some embodiments, the protease has an amino acid sequence of SEQ ID NO: 151. In some embodiments, the protease has an amino acid sequence of SEQ ID NO: 152. In some embodiments, the protease has an amino acid sequence of SEQ ID NO: 153. In some embodiments, the protease has an amino acid sequence of SEQ ID NO: 154. In some embodiments, the protease has an amino acid sequence of SEQ ID NO: 155. In some embodiments, the protease has an amino acid sequence of SEQ ID NO: 156. In some embodiments, the protease has an amino acid sequence of SEQ ID NO: 157. In some embodiments, the protease has an amino acid sequence of SEQ ID NO: 158. In some embodiments, the protease has an amino acid sequence of SEQ ID NO: 159. In some embodiments, the protease has an amino acid sequence of SEQ ID NO: 160. In some embodiments, the protease has an amino acid sequence of SEQ ID NO: 161. In some embodiments, the protease has an amino acid sequence of SEQ ID NO: 162. In some embodiments, the protease has an amino acid sequence of SEQ ID NO: 163. In some embodiments, the protease has an amino acid sequence of SEQ ID NO: 164. In some embodiments, the protease has an amino acid sequence of SEQ ID NO: 165. In some embodiments, the protease has an amino acid sequence of SEQ ID NO: 166. In some embodiments, the protease has an amino acid sequence of SEQ ID NO: 167. In some embodiments, the protease has an amino acid sequence of SEQ ID NO: 168. In some embodiments, the protease has an amino acid sequence of SEQ ID NO: 169. In some embodiments, the protease has an amino acid sequence of SEQ ID NO: 170. In some embodiments, the protease has an amino acid sequence of SEQ ID NO: 171. In some embodiments, the protease has an amino acid sequence of SEQ ID NO: 172. In some embodiments, the protease has an amino acid sequence of SEQ ID NO: 173. In some embodiments, the protease has an amino acid sequence of SEQ ID NO: 174. In some embodiments, the protease has an amino acid sequence of SEQ ID NO: 175. In some embodiments, the protease has an amino acid sequence of SEQ ID NO: 176. In some embodiments, the protease has an amino acid sequence of SEQ ID NO: 177. In some embodiments, the protease has an amino acid sequence of SEQ ID NO: 178. In some embodiments, the protease has an amino acid sequence of SEQ ID NO: 179. In some embodiments, the protease has an amino acid sequence of SEQ ID NO: 180. In some embodiments, the protease has an amino acid sequence of SEQ ID NO: 181. In some embodiments, the protease has an amino acid sequence of SEQ ID NO: 182. In some embodiments, the protease has an amino acid sequence of SEQ ID NO: 183. In some embodiments, the protease has an amino acid sequence of SEQ ID NO: 184. In some embodiments, the protease has an amino acid sequence of SEQ ID NO: 185. In some embodiments, the protease has an amino acid sequence of SEQ ID NO: 186. In some embodiments, the protease has an amino acid sequence of SEQ ID NO: 187. In some embodiments, the protease has an amino acid sequence of SEQ ID NO: 188. In some embodiments, the protease has an amino acid sequence of SEQ ID NO: 189. In some embodiments, the protease has an amino acid sequence of SEQ ID NO: 190. In some embodiments, the protease has an amino acid sequence of SEQ ID NO: 191. In some embodiments, the protease has an amino acid sequence of SEQ ID NO: 192. In some embodiments, the protease has an amino acid sequence of SEQ ID NO: 193. In some embodiments, the protease has an amino acid sequence of SEQ ID NO: 194. In some embodiments, the protease has an amino acid sequence of SEQ ID NO: 195. In some embodiments, the protease has an amino acid sequence of SEQ ID NO: 196. In some embodiments, the protease has an amino acid sequence of SEQ ID NO: 197. In some embodiments, the protease has an amino acid sequence of SEQ ID NO: 198. In some embodiments, the protease has an amino acid sequence of SEQ ID NO: 199. In some embodiments, the protease has an amino acid sequence of SEQ ID NO: 200. In some embodiments, the protease has an amino acid sequence of SEQ ID NO: 201. In some embodiments, the protease has an amino acid sequence of SEQ ID NO: 202. In some embodiments, the protease has an amino acid sequence of SEQ ID NO: 203. In some embodiments, the protease has an amino acid sequence of SEQ ID NO: 204. In some embodiments, the protease has an amino acid sequence of SEQ ID NO: 205. In some embodiments, the protease has an amino acid sequence of SEQ ID NO: 206. In some embodiments, the protease has an amino acid sequence of SEQ ID NO: 207. In some embodiments, the protease has an amino acid sequence of SEQ ID NO: 208. In some embodiments, the protease has an amino acid sequence of SEQ ID NO: 209. In some embodiments, the protease has an amino acid sequence of SEQ ID NO: 210. In some embodiments, the protease has an amino acid sequence of SEQ ID NO: 211. In some embodiments, the protease has an amino acid sequence of SEQ ID NO: 212. In some embodiments, the protease has an amino acid sequence of SEQ ID NO: 213. In some embodiments, the protease has an amino acid sequence of SEQ ID NO: 214. In some embodiments, the protease has an amino acid sequence of SEQ ID NO: 215. In some embodiments, the protease has an amino acid sequence of SEQ ID NO: 216. In some embodiments, the protease has an amino acid sequence of SEQ ID NO: 217. In some embodiments, the protease has an amino acid sequence of SEQ ID NO: 218. In some embodiments, the protease has an amino acid sequence of SEQ ID NO: 219. In some embodiments, the protease has an amino acid sequence of SEQ ID NO: 220. In some embodiments, the protease has an amino acid sequence of SEQ ID NO: 221. In some embodiments, the protease has an amino acid sequence of SEQ ID NO: 222. In some embodiments, the protease has an amino acid sequence of SEQ ID NO: 223. In some embodiments, the protease has an amino acid sequence of SEQ ID NO: 224. In some embodiments, the protease has an amino acid sequence of SEQ ID NO: 225. In some embodiments, the protease has an amino acid sequence of SEQ ID NO: 226. In some embodiments, the protease has an amino acid sequence of SEQ ID NO: 227. In some embodiments, the protease has an amino acid sequence of SEQ ID NO: 228. In some embodiments, the protease has an amino acid sequence of SEQ ID NO: 229. In some embodiments, the protease has an amino acid sequence of SEQ ID NO: 230. In some embodiments, the protease has an amino acid sequence of SEQ ID NO: 231. In some embodiments, the protease has an amino acid sequence of SEQ ID NO: 232. In some embodiments, the protease has an amino acid sequence of SEQ ID NO: 233. In some embodiments, the protease has an amino acid sequence of SEQ ID NO: 234. In some embodiments, the protease has an amino acid sequence of SEQ ID NO: 235. In some embodiments, the protease has an amino acid sequence of SEQ ID NO: 236. In some embodiments, the protease has an amino acid sequence of SEQ ID NO: 237. In some embodiments, the protease has an amino acid sequence of SEQ ID NO: 238. In some embodiments, the protease has an amino acid sequence of SEQ ID NO: 239. In some embodiments, the protease has an amino acid sequence of SEQ ID NO: 240. In some embodiments, the protease has an amino acid sequence of SEQ ID NO: 241. In some embodiments, the protease has an amino acid sequence of SEQ ID NO: 242. In some embodiments, the protease has an amino acid sequence of SEQ ID NO: 243. In some embodiments, the protease has an amino acid sequence of SEQ ID NO: 244. In some embodiments, the protease has an amino acid sequence of SEQ ID NO: 245. In some embodiments, the protease has an amino acid sequence of SEQ ID NO: 246. In some embodiments, the protease has an amino acid sequence of SEQ ID NO: 247. In some embodiments, the protease has an amino acid sequence of SEQ ID NO: 248. In some embodiments, the protease has an amino acid sequence of SEQ ID NO: 249. In some embodiments, the protease has an amino acid sequence of SEQ ID NO: 250. In some embodiments, the protease has an amino acid sequence of SEQ ID NO: 251. In some embodiments, the protease has an amino acid sequence of SEQ ID NO: 252. In some embodiments, the protease has an amino acid sequence of SEQ ID NO: 253. In some embodiments, the protease has an amino acid sequence of SEQ ID NO: 254. In some embodiments, the protease has an amino acid sequence of SEQ ID NO: 255. In some embodiments, the protease has an amino acid sequence of SEQ ID NO: 256. In some embodiments, the protease has an amino acid sequence of SEQ ID NO: 257. In some embodiments, the protease has an amino acid sequence of SEQ ID NO: 258. In some embodiments, the protease has an amino acid sequence of SEQ ID NO: 259. In some embodiments, the protease has an amino acid sequence of SEQ ID NO: 260. In some embodiments, the protease has an amino acid sequence of SEQ ID NO: 261. In some embodiments, the protease has an amino acid sequence of SEQ ID NO: 262. In some embodiments, the protease has an amino acid sequence of SEQ ID NO: 263. In some embodiments, the protease has an amino acid sequence of SEQ ID NO: 264. In some embodiments, the protease has an amino acid sequence of SEQ ID NO: 265. In some embodiments, the protease has an amino acid sequence of SEQ ID NO: 266. In some embodiments, the protease has an amino acid sequence of SEQ ID NO: 267. In some embodiments, the protease has an amino acid sequence of SEQ ID NO: 268. In some embodiments, the protease has an amino acid sequence of SEQ ID NO: 269. In some embodiments, the protease has an amino acid sequence of SEQ ID NO: 270. In some embodiments, the protease has an amino acid sequence of SEQ ID NO: 271. In some embodiments, the protease has an amino acid sequence of SEQ ID NO: 272. In some embodiments, the protease has an amino acid sequence of SEQ ID NO: 273. In some embodiments, the protease has an amino acid sequence of SEQ ID NO: 274. In some embodiments, the protease has an amino acid sequence of SEQ ID NO: 275. In some embodiments, the protease has an amino acid sequence of SEQ ID NO: 276. In some embodiments, the protease has an amino acid sequence of SEQ ID NO: 277.

In some embodiments, the protease has an amino acid sequence of SEQ ID NO: 278. In some embodiments, the protease has an amino acid sequence of SEQ ID NO: 279. In some embodiments, the protease has an amino acid sequence of SEQ ID NO: 280. In some embodiments, the protease has an amino acid sequence of SEQ ID NO: 281. In some embodiments, the protease has an amino acid sequence of SEQ ID NO: 282. In some embodiments, the protease has an amino acid sequence of SEQ ID NO: 283. In some embodiments, the protease has an amino acid sequence of SEQ ID NO: 284. In some embodiments, the protease has an amino acid sequence of SEQ ID NO: 285. In some embodiments, the protease has an amino acid sequence of SEQ ID NO: 286. In some embodiments, the protease has an amino acid sequence of SEQ ID NO: 287. In some embodiments, the protease has an amino acid sequence of SEQ ID NO: 288. In some embodiments, the protease has an amino acid sequence of SEQ ID NO: 289. In some embodiments, the protease has an amino acid sequence of SEQ ID NO: 290. In some embodiments, the protease has an amino acid sequence of SEQ ID NO: 291. In some embodiments, the protease has an amino acid sequence of SEQ ID NO: 292. In some embodiments, the protease has an amino acid sequence of SEQ ID NO: 293. In some embodiments, the protease has an amino acid sequence of SEQ ID NO: 294. In some embodiments, the protease has an amino acid sequence of SEQ ID NO: 295. In some embodiments, the protease has an amino acid sequence of SEQ ID NO: 296. In some embodiments, the protease has an amino acid sequence of SEQ ID NO: 297. In some embodiments, the protease has an amino acid sequence of SEQ ID NO: 298. In some embodiments, the protease has an amino acid sequence of SEQ ID NO: 299. In some embodiments, the protease has an amino acid sequence of SEQ ID NO: 300. In some embodiments, the protease has an amino acid sequence of SEQ ID NO: 301. In some embodiments, the protease has an amino acid sequence of SEQ ID NO: 302. In some embodiments, the protease has an amino acid sequence of SEQ ID NO: 303. In some embodiments, the protease has an amino acid sequence of SEQ ID NO: 304. In some embodiments, the protease has an amino acid sequence of SEQ ID NO: 305. In some embodiments, the protease has an amino acid sequence of SEQ ID NO: 306. In some embodiments, the protease has an amino acid sequence of SEQ ID NO: 307. In some embodiments, the protease has an amino acid sequence of SEQ ID NO: 308. In some embodiments, the protease has an amino acid sequence of SEQ ID NO: 309. In some embodiments, the protease has an amino acid sequence of SEQ ID NO: 310. In some embodiments, the protease has an amino acid sequence of SEQ ID NO: 311. In some embodiments, the protease has an amino acid sequence of SEQ ID NO: 312. In some embodiments, the protease has an amino acid sequence of SEQ ID NO: 313. In some embodiments, the protease has an amino acid sequence of SEQ ID NO: 314. In some embodiments, the protease has an amino acid sequence of SEQ ID NO: 315. In some embodiments, the protease has an amino acid sequence of SEQ ID NO: 316. In some embodiments, the protease has an amino acid sequence of SEQ ID NO: 317. In some embodiments, the protease has an amino acid sequence of SEQ ID NO: 318. In some embodiments, the protease has an amino acid sequence of SEQ ID NO: 319. In some embodiments, the protease has an amino acid sequence of SEQ ID NO: 320. In some embodiments, the protease has an amino acid sequence of SEQ ID NO: 321. In some embodiments, the protease has an amino acid sequence of SEQ ID NO: 322. In some embodiments, the protease has an amino acid sequence of SEQ ID NO: 323. In some embodiments, the protease has an amino acid sequence of SEQ ID NO: 324. In some embodiments, the protease has an amino acid sequence of SEQ ID NO: 325. In some embodiments, the protease has an amino acid sequence of SEQ ID NO: 326. In some embodiments, the protease has an amino acid sequence of SEQ ID NO: 327. In some embodiments, the protease has an amino acid sequence of SEQ ID NO: 328. In some embodiments, the protease has an amino acid sequence of SEQ ID NO: 329. In some embodiments, the protease has an amino acid sequence of SEQ ID NO: 330. In some embodiments, the protease has an amino acid sequence of SEQ ID NO: 331. In some embodiments, the protease has an amino acid sequence of SEQ ID NO: 332. In some embodiments, the protease has an amino acid sequence of SEQ ID NO: 333. In some embodiments, the protease has an amino acid sequence of SEQ ID NO: 334. In some embodiments, the protease has an amino acid sequence of SEQ ID NO: 335. In some embodiments, the protease has an amino acid sequence of SEQ ID NO: 336. In some embodiments, the protease has an amino acid sequence of SEQ ID NO: 337. In some embodiments, the protease has an amino acid sequence of SEQ ID NO: 338. In some embodiments, the protease has an amino acid sequence of SEQ ID NO: 339. In some embodiments, the protease has an amino acid sequence of SEQ ID NO: 340. In some embodiments, the protease has an amino acid sequence of SEQ ID NO: 341. In some embodiments, the protease has an amino acid sequence of SEQ ID NO: 342. In some embodiments, the protease has an amino acid sequence of SEQ ID NO: 343. In some embodiments, the protease has an amino acid sequence of SEQ ID NO: 344. In some embodiments, the protease has an amino acid sequence of SEQ ID NO: 345. In some embodiments, the protease has an amino acid sequence of SEQ ID NO: 346. In some embodiments, the protease has an amino acid sequence of SEQ ID NO: 347. In some embodiments, the protease has an amino acid sequence of SEQ ID NO: 348. In some embodiments, the protease has an amino acid sequence of SEQ ID NO: 349. In some embodiments, the protease has an amino acid sequence of SEQ ID NO: 350. In some embodiments, the protease has an amino acid sequence of SEQ ID NO: 351. In some embodiments, the protease has an amino acid sequence of SEQ ID NO: 352. In some embodiments, the protease has an amino acid sequence of SEQ ID NO: 353. In some embodiments, the protease has an amino acid sequence of SEQ ID NO: 354. In some embodiments, the protease has an amino acid sequence of SEQ ID NO: 355. In some embodiments, the protease has an amino acid sequence of SEQ ID NO: 356. In some embodiments, the protease has an amino acid sequence of SEQ ID NO: 357. In some embodiments, the protease has an amino acid sequence of SEQ ID NO: 358. In some embodiments, the protease has an amino acid sequence of SEQ ID NO: 359. In some embodiments, the protease has an amino acid sequence of SEQ ID NO: 360. In some embodiments, the protease has an amino acid sequence of SEQ ID NO: 361. In some embodiments, the protease has an amino acid sequence of SEQ ID NO: 362. In some embodiments, the protease has an amino acid sequence of SEQ ID NO: 363. In some embodiments, the protease has an amino acid sequence of SEQ ID NO: 364. In some embodiments, the protease has an amino acid sequence of SEQ ID NO: 365. In some embodiments, the protease has an amino acid sequence of SEQ ID NO: 366. In some embodiments, the protease has an amino acid sequence of SEQ ID NO: 367. In some embodiments, the protease has an amino acid sequence of SEQ ID NO: 368. In some embodiments, the protease has an amino acid sequence of SEQ ID NO: 369. In some embodiments, the protease has an amino acid sequence of SEQ ID NO: 370. In some embodiments, the protease has an amino acid sequence of SEQ ID NO: 371. In some embodiments, the protease has an amino acid sequence of SEQ ID NO: 372. In some embodiments, the protease has an amino acid sequence of SEQ ID NO: 373. In some embodiments, the protease has an amino acid sequence of SEQ ID NO: 374. In some embodiments, the protease has an amino acid sequence of SEQ ID NO: 375. In some embodiments, the protease has an amino acid sequence of SEQ ID NO: 376. In some embodiments, the protease has an amino acid sequence of SEQ ID NO: 377. In some embodiments, the protease has an amino acid sequence of SEQ ID NO: 378. In some embodiments, the protease has an amino acid sequence of SEQ ID NO: 379. In some embodiments, the protease has an amino acid sequence of SEQ ID NO: 380. In some embodiments, the protease has an amino acid sequence of SEQ ID NO: 381. In some embodiments, the protease has an amino acid sequence of SEQ ID NO: 382. In some embodiments, the protease has an amino acid sequence of SEQ ID NO: 383. In some embodiments, the protease has an amino acid sequence of SEQ ID NO: 384. In some embodiments, the protease has an amino acid sequence of SEQ ID NO: 385. In some embodiments, the protease has an amino acid sequence of SEQ ID NO: 386. In some embodiments, the protease has an amino acid sequence of SEQ ID NO: 387. In some embodiments, the protease has an amino acid sequence of SEQ ID NO: 388. In some embodiments, the protease has an amino acid sequence of SEQ ID NO: 389. In some embodiments, the protease has an amino acid sequence of SEQ ID NO: 390. In some embodiments, the protease has an amino acid sequence of SEQ ID NO: 391. In some embodiments, the protease has an amino acid sequence of SEQ ID NO: 392. In some embodiments, the protease has an amino acid sequence of SEQ ID NO: 393. In some embodiments, the protease has an amino acid sequence of SEQ ID NO: 394. In some embodiments, the protease has an amino acid sequence of SEQ ID NO: 395. In some embodiments, the protease has an amino acid sequence of SEQ ID NO: 396. In some embodiments, the protease has an amino acid sequence of SEQ ID NO: 397. In some embodiments, the protease has an amino acid sequence of SEQ ID NO: 398. In some embodiments, the protease has an amino acid sequence of SEQ ID NO: 399. In some embodiments, the protease has an amino acid sequence of SEQ ID NO: 400. In some embodiments, the protease has an amino acid sequence of SEQ ID NO: 401. In some embodiments, the protease has an amino acid sequence of SEQ ID NO: 402. In some embodiments, the protease has an amino acid sequence of SEQ ID NO: 403. In some embodiments, the protease has an amino acid sequence of SEQ ID NO: 404. In some embodiments, the protease has an amino acid sequence of SEQ ID NO: 405. In some embodiments, the protease has an amino acid sequence of SEQ ID NO: 406. In some embodiments, the protease has an amino acid sequence of SEQ ID NO: 407. In some embodiments, the protease has an amino acid sequence of SEQ ID NO: 408. In some embodiments, the protease has an amino acid sequence of SEQ ID NO: 409. In some embodiments, the protease has an amino acid sequence of SEQ ID NO: 410. In some embodiments, the protease has an amino acid sequence of SEQ ID NO: 411. In some embodiments, the protease has an amino acid sequence of SEQ ID NO: 412. In some embodiments, the protease has an amino acid sequence of SEQ ID NO: 413. In some embodiments, the protease has an amino acid sequence of SEQ ID NO: 414. In some embodiments, the protease has an amino acid sequence of SEQ ID NO: 415. In some embodiments, the protease has an amino acid sequence of SEQ ID NO: 416. In some embodiments, the protease has an amino acid sequence of SEQ ID NO: 417. In some embodiments, the protease has an amino acid sequence of SEQ ID NO: 418. In some embodiments, the protease has an amino acid sequence of SEQ ID NO: 419. In some embodiments, the protease has an amino acid sequence of SEQ ID NO: 420. In some embodiments, the protease has an amino acid sequence of SEQ ID NO: 421. In some embodiments, the protease has an amino acid sequence of SEQ ID NO: 422. In some embodiments, the protease has an amino acid sequence of SEQ ID NO: 423. In some embodiments, the protease has an amino acid sequence of SEQ ID NO: 424. In some embodiments, the protease has an amino acid sequence of SEQ ID NO: 425. In some embodiments, the protease has an amino acid sequence of SEQ ID NO: 426. In some embodiments, the protease has an amino acid sequence of SEQ ID NO: 427. In some embodiments, the protease has an amino acid sequence of SEQ ID NO: 428. In some embodiments, the protease has an amino acid sequence of SEQ ID NO: 429. In some embodiments, the protease has an amino acid sequence of SEQ ID NO: 430. In some embodiments, the protease has an amino acid sequence of SEQ ID NO: 431. In some embodiments, the protease has an amino acid sequence of SEQ ID NO: 432. In some embodiments, the protease has an amino acid sequence of SEQ ID NO: 433. In some embodiments, the protease has an amino acid sequence of SEQ ID NO: 434. In some embodiments, the protease has an amino acid sequence of SEQ ID NO: 435. In some embodiments, the protease has an amino acid sequence of SEQ ID NO: 436. In some embodiments, the protease has an amino acid sequence of SEQ ID NO: 437. In some embodiments, the protease has an amino acid sequence of SEQ ID NO: 438. In some embodiments, the protease has an amino acid sequence of SEQ ID NO: 439. In some embodiments, the protease has an amino acid sequence of SEQ ID NO: 440. In some embodiments, the protease has an amino acid sequence of SEQ ID NO: 441. In some embodiments, the protease has an amino acid sequence of SEQ ID NO: 442. In some embodiments, the protease has an amino acid sequence of SEQ ID NO: 443. In some embodiments, the protease has an amino acid sequence of SEQ ID NO: 444. In some embodiments, the protease has an amino acid sequence of SEQ ID NO: 445. In some embodiments, the protease has an amino acid sequence of SEQ ID NO: 446. In some embodiments, the protease has an amino acid sequence of SEQ ID NO: 447. In some embodiments, the protease has an amino acid sequence of SEQ ID NO: 448. In some embodiments, the protease has an amino acid sequence of SEQ ID NO: 449. In some embodiments, the protease has an amino acid sequence of SEQ ID NO: 450. In some embodiments, the protease has an amino acid sequence of SEQ ID NO: 451. In some embodiments, the protease has an amino acid sequence of SEQ ID NO: 452. In some embodiments, the protease has an amino acid sequence of SEQ ID NO: 453. In some embodiments, the protease has an amino acid sequence of SEQ ID NO: 454. In some embodiments, the protease has an amino acid sequence of SEQ ID NO: 455. In some embodiments, the protease has an amino acid sequence of SEQ ID NO: 456. In some embodiments, the protease has an amino acid sequence of SEQ ID NO: 457. In some embodiments, the protease has an amino acid sequence of SEQ ID NO: 458. In some embodiments, the protease has an amino acid sequence of SEQ ID NO: 459. In some embodiments, the protease has an amino acid sequence of SEQ ID NO: 460. In some embodiments, the protease has an amino acid sequence of SEQ ID NO: 461. In some embodiments, the protease has an amino acid sequence of SEQ ID NO: 462. In some embodiments, the protease has an amino acid sequence of SEQ ID NO: 463. In some embodiments, the protease has an amino acid sequence of SEQ ID NO: 464. In some embodiments, the protease has an amino acid sequence of SEQ ID NO: 465. In some embodiments, the protease has an amino acid sequence of SEQ ID NO: 466. In some embodiments, the protease has an amino acid sequence of SEQ ID NO: 467. In some embodiments, the protease has an amino acid sequence of SEQ ID NO: 468. In some embodiments, the protease has an amino acid sequence of SEQ ID NO: 469. In some embodiments, the protease has an amino acid sequence of SEQ ID NO: 470. In some embodiments, the protease has an amino acid sequence of SEQ ID NO: 471. In some embodiments, the protease has an amino acid sequence of SEQ ID NO: 472. In some embodiments, the protease has an amino acid sequence of SEQ ID NO: 473. In some embodiments, the protease has an amino acid sequence of SEQ ID NO: 474. In some embodiments, the protease has an amino acid sequence of SEQ ID NO: 475. In some embodiments, the protease has an amino acid sequence of SEQ ID NO: 476. In some embodiments, the protease has an amino acid sequence of SEQ ID NO: 477. In some embodiments, the protease has an amino acid sequence of SEQ ID NO: 478. In some embodiments, the protease has an amino acid sequence of SEQ ID NO: 479. In some embodiments, the protease has an amino acid sequence of SEQ ID NO: 480. In some embodiments, the protease has an amino acid sequence of SEQ ID NO: 481. In some embodiments, the protease has an amino acid sequence of SEQ ID NO: 482. In some embodiments, the protease has an amino acid sequence of SEQ ID NO: 483. In some embodiments, the protease has an amino acid sequence of SEQ ID NO: 484. In some embodiments, the protease has an amino acid sequence of SEQ ID NO: 485. In some embodiments, the protease has an amino acid sequence of SEQ ID NO: 486. In some embodiments, the protease has an amino acid sequence of SEQ ID NO: 487. In some embodiments, the protease has an amino acid sequence of SEQ ID NO: 488. In some embodiments, the protease has an amino acid sequence of SEQ ID NO: 489. In some embodiments, the protease has an amino acid sequence of SEQ ID NO: 490. In some embodiments, the protease has an amino acid sequence of SEQ ID NO: 491. In some embodiments, the protease has an amino acid sequence of SEQ ID NO: 492. In some embodiments, the protease has an amino acid sequence of SEQ ID NO: 493. In some embodiments, the protease has an amino acid sequence of SEQ ID NO: 494. In some embodiments, the protease has an amino acid sequence of SEQ ID NO: 495. In some embodiments, the protease has an amino acid sequence of SEQ ID NO: 496. In some embodiments, the protease has an amino acid sequence of SEQ ID NO: 497. In some embodiments, the protease has an amino acid sequence of SEQ ID NO: 498. In some embodiments, the protease has an amino acid sequence of SEQ ID NO: 499. In some embodiments, the protease has an amino acid sequence of SEQ ID NO: 500. In some embodiments, the protease has an amino acid sequence of SEQ ID NO: 501. In some embodiments, the protease has an amino acid sequence of SEQ ID NO: 502. In some embodiments, the protease has an amino acid sequence of SEQ ID NO: 503. In some embodiments, the protease has an amino acid sequence of SEQ ID NO: 504. In some embodiments, the protease has an amino acid sequence of SEQ ID NO: 505. In some embodiments, the protease has an amino acid sequence of SEQ ID NO: 506. In some embodiments, the protease has an amino acid sequence of SEQ ID NO: 507. In some embodiments, the protease has an amino acid sequence of SEQ ID NO: 508. In some embodiments, the protease has an amino acid sequence of SEQ ID NO: 509. In some embodiments, the protease has an amino acid sequence of SEQ ID NO: 510. In some embodiments, the protease has an amino acid sequence of SEQ ID NO: 511. In some embodiments, the protease has an amino acid sequence of SEQ ID NO: 512. In some embodiments, the protease has an amino acid sequence of SEQ ID NO: 513. In some embodiments, the protease has an amino acid sequence of SEQ ID NO: 514. In some embodiments, the protease has an amino acid sequence of SEQ ID NO: 515. In some embodiments, the protease has an amino acid sequence of SEQ ID NO: 516. In some embodiments, the protease has an amino acid sequence of SEQ ID NO: 517. In some embodiments, the protease has an amino acid sequence of SEQ ID NO: 518. In some embodiments, the protease has an amino acid sequence of SEQ ID NO: 519. In some embodiments, the protease has an amino acid sequence of SEQ ID NO: 520. In some embodiments, the protease has an amino acid sequence of SEQ ID NO: 521. In some embodiments, the protease has an amino acid sequence of SEQ ID NO: 522. In some embodiments, the protease has an amino acid sequence of SEQ ID NO: 523. In some embodiments, the protease has an amino acid sequence of SEQ ID NO: 524. In some embodiments, the protease has an amino acid sequence of SEQ ID NO: 525. In some embodiments, the protease has an amino acid sequence of SEQ ID NO: 526. In some embodiments, the protease has an amino acid sequence of SEQ ID NO: 527. In some embodiments, the protease has an amino acid sequence of SEQ ID NO: 528. In some embodiments, the protease has an amino acid sequence of SEQ ID NO: 529. In some embodiments, the protease has an amino acid sequence of SEQ ID NO: 530. In some embodiments, the protease has an amino acid sequence of SEQ ID NO: 531. In some embodiments, the protease has an amino acid sequence of SEQ ID NO: 532. In some embodiments, the protease has an amino acid sequence of SEQ ID NO: 533. In some embodiments, the protease has an amino acid sequence of SEQ ID NO: 534. In some embodiments, the protease has an amino acid sequence of SEQ ID NO: 535. In some embodiments, the protease has an amino acid sequence of SEQ ID NO: 536. In some embodiments, the protease has an amino acid sequence of SEQ ID NO: 537. In some embodiments, the protease has an amino acid sequence of SEQ ID NO: 538. In some embodiments, the protease has an amino acid sequence of SEQ ID NO: 539. In some embodiments, the protease has an amino acid sequence of SEQ ID NO: 540. In some embodiments, the protease has an amino acid sequence of SEQ ID NO: 541. In some embodiments, the protease has an amino acid sequence of SEQ ID NO: 542. In some embodiments, the protease has an amino acid sequence of SEQ ID NO: 543. In some embodiments, the protease has an amino acid sequence of SEQ ID NO: 544. In some embodiments, the protease has an amino acid sequence of SEQ ID NO: 545.

In some embodiments, the protease has an amino acid sequence of SEQ ID NO: 546. In some embodiments, the protease has an amino acid sequence of SEQ ID NO: 547. In some embodiments, the protease has an amino acid sequence of SEQ ID NO: 548. In some embodiments, the protease has an amino acid sequence of SEQ ID NO: 549. In some embodiments, the protease has an amino acid sequence of SEQ ID NO: 550. In some embodiments, the protease has an amino acid sequence of SEQ ID NO: 551. In some embodiments, the protease has an amino acid sequence of SEQ ID NO: 552. In some embodiments, the protease has an amino acid sequence of SEQ ID NO: 553. In some embodiments, the protease has an amino acid sequence of SEQ ID NO: 554. In some embodiments, the protease has an amino acid sequence of SEQ ID NO: 555. In some embodiments, the protease has an amino acid sequence of SEQ ID NO: 556. In some embodiments, the protease has an amino acid sequence of SEQ ID NO: 557. In some embodiments, the protease has an amino acid sequence of SEQ ID NO: 558. In some embodiments, the protease has an amino acid sequence of SEQ ID NO: 559. In some embodiments, the protease has an amino acid sequence of SEQ ID NO: 560. In some embodiments, the protease has an amino acid sequence of SEQ ID NO: 561. In some embodiments, the protease has an amino acid sequence of SEQ ID NO: 562. In some embodiments, the protease has an amino acid sequence of SEQ ID NO: 563. In some embodiments, the protease has an amino acid sequence of SEQ ID NO: 564. In some embodiments, the protease has an amino acid sequence of SEQ ID NO: 565. In some embodiments, the protease has an amino acid sequence of SEQ ID NO: 566. In some embodiments, the protease has an amino acid sequence of SEQ ID NO: 567. In some embodiments, the protease has an amino acid sequence of SEQ ID NO: 568. In some embodiments, the protease has an amino acid sequence of SEQ ID NO: 569. In some embodiments, the protease has an amino acid sequence of SEQ ID NO: 570. In some embodiments, the protease has an amino acid sequence of SEQ ID NO: 571. In some embodiments, the protease has an amino acid sequence of SEQ ID NO: 572. In some embodiments, the protease has an amino acid sequence of SEQ ID NO: 573. In some embodiments, the protease has an amino acid sequence of SEQ ID NO: 574. In some embodiments, the protease has an amino acid sequence of SEQ ID NO: 575. In some embodiments, the protease has an amino acid sequence of SEQ ID NO: 576. In some embodiments, the protease has an amino acid sequence of SEQ ID NO: 577. In some embodiments, the protease has an amino acid sequence of SEQ ID NO: 578. In some embodiments, the protease has an amino acid sequence of SEQ ID NO: 579. In some embodiments, the protease has an amino acid sequence of SEQ ID NO: 580. In some embodiments, the protease has an amino acid sequence of SEQ ID NO: 581. In some embodiments, the protease has an amino acid sequence of SEQ ID NO: 582. In some embodiments, the protease has an amino acid sequence of SEQ ID NO: 583. In some embodiments, the protease has an amino acid sequence of SEQ ID NO: 584. In some embodiments, the protease has an amino acid sequence of SEQ ID NO: 585. In some embodiments, the protease has an amino acid sequence of SEQ ID NO: 586. In some embodiments, the protease has an amino acid sequence of SEQ ID NO: 587. In some embodiments, the protease has an amino acid sequence of SEQ ID NO: 588. In some embodiments, the protease has an amino acid sequence of SEQ ID NO: 589. In some embodiments, the protease has an amino acid sequence of SEQ ID NO: 590. In some embodiments, the protease has an amino acid sequence of SEQ ID NO: 591. In some embodiments, the protease has an amino acid sequence of SEQ ID NO: 592. In some embodiments, the protease has an amino acid sequence of SEQ ID NO: 593. In some embodiments, the protease has an amino acid sequence of SEQ ID NO: 594. In some embodiments, the protease has an amino acid sequence of SEQ ID NO: 595. In some embodiments, the protease has an amino acid sequence of SEQ ID NO: 596. In some embodiments, the protease has an amino acid sequence of SEQ ID NO: 597. In some embodiments, the protease has an amino acid sequence of SEQ ID NO: 598. In some embodiments, the protease has an amino acid sequence of SEQ ID NO: 599. In some embodiments, the protease has an amino acid sequence of SEQ ID NO: 600. In some embodiments, the protease has an amino acid sequence of SEQ ID NO: 601. In some embodiments, the protease has an amino acid sequence of SEQ ID NO: 602. In some embodiments, the protease has an amino acid sequence of SEQ ID NO: 603. In some embodiments, the protease has an amino acid sequence of SEQ ID NO: 604. In some embodiments, the protease has an amino acid sequence of SEQ ID NO: 605. In some embodiments, the protease has an amino acid sequence of SEQ ID NO: 606. In some embodiments, the protease has an amino acid sequence of SEQ ID NO: 607. In some embodiments, the protease has an amino acid sequence of SEQ ID NO: 608. In some embodiments, the protease has an amino acid sequence of SEQ ID NO: 609. In some embodiments, the protease has an amino acid sequence of SEQ ID NO: 610. In some embodiments, the protease has an amino acid sequence of SEQ ID NO: 611. In some embodiments, the protease has an amino acid sequence of SEQ ID NO: 612. In some embodiments, the protease has an amino acid sequence of SEQ ID NO: 613. In some embodiments, the protease has an amino acid sequence of SEQ ID NO: 614. In some embodiments, the protease has an amino acid sequence of SEQ ID NO: 615. In some embodiments, the protease has an amino acid sequence of SEQ ID NO: 616. In some embodiments, the protease has an amino acid sequence of SEQ ID NO: 617. In some embodiments, the protease has an amino acid sequence of SEQ ID NO: 618. In some embodiments, the protease has an amino acid sequence of SEQ ID NO: 619. In some embodiments, the protease has an amino acid sequence of SEQ ID NO: 620. In some embodiments, the protease has an amino acid sequence of SEQ ID NO: 621. In some embodiments, the protease has an amino acid sequence of SEQ ID NO: 622. In some embodiments, the protease has an amino acid sequence of SEQ ID NO: 623. In some embodiments, the protease has an amino acid sequence of SEQ ID NO: 624. In some embodiments, the protease has an amino acid sequence of SEQ ID NO: 625. In some embodiments, the protease has an amino acid sequence of SEQ ID NO: 626. In some embodiments, the protease has an amino acid sequence of SEQ ID NO: 627. In some embodiments, the protease has an amino acid sequence of SEQ ID NO: 628. In some embodiments, the protease has an amino acid sequence of SEQ ID NO: 629. In some embodiments, the protease has an amino acid sequence of SEQ ID NO: 630. In some embodiments, the protease has an amino acid sequence of SEQ ID NO: 631. In some embodiments, the protease has an amino acid sequence of SEQ ID NO: 632. In some embodiments, the protease has an amino acid sequence of SEQ ID NO: 633. In some embodiments, the protease has an amino acid sequence of SEQ ID NO: 634. In some embodiments, the protease has an amino acid sequence of SEQ ID NO: 635. In some embodiments, the protease has an amino acid sequence of SEQ ID NO: 636. In some embodiments, the protease has an amino acid sequence of SEQ ID NO: 637. In some embodiments, the protease has an amino acid sequence of SEQ ID NO: 638. In some embodiments, the protease has an amino acid sequence of SEQ ID NO: 639. In some embodiments, the protease has an amino acid sequence of SEQ ID NO: 640. In some embodiments, the protease has an amino acid sequence of SEQ ID NO: 641. In some embodiments, the protease has an amino acid sequence of SEQ ID NO: 642. In some embodiments, the protease has an amino acid sequence of SEQ ID NO: 643. In some embodiments, the protease has an amino acid sequence of SEQ ID NO: 644. In some embodiments, the protease has an amino acid sequence of SEQ ID NO: 645. In some embodiments, the protease has an amino acid sequence of SEQ ID NO: 646. In some embodiments, the protease has an amino acid sequence of SEQ ID NO: 647. In some embodiments, the protease has an amino acid sequence of SEQ ID NO: 648. In some embodiments, the protease has an amino acid sequence of SEQ ID NO: 649. In some embodiments, the protease has an amino acid sequence of SEQ ID NO: 650. In some embodiments, the protease has an amino acid sequence of SEQ ID NO: 651. In some embodiments, the protease has an amino acid sequence of SEQ ID NO: 652. In some embodiments, the protease has an amino acid sequence of SEQ ID NO: 653. In some embodiments, the protease has an amino acid sequence of SEQ ID NO: 654. In some embodiments, the protease has an amino acid sequence of SEQ ID NO: 655. In some embodiments, the protease has an amino acid sequence of SEQ ID NO: 656. In some embodiments, the protease has an amino acid sequence of SEQ ID NO: 657. In some embodiments, the protease has an amino acid sequence of SEQ ID NO: 658. In some embodiments, the protease has an amino acid sequence of SEQ ID NO: 659. In some embodiments, the protease has an amino acid sequence of SEQ ID NO: 660. In some embodiments, the protease has an amino acid sequence of SEQ ID NO: 661. In some embodiments, the protease has an amino acid sequence of SEQ ID NO: 662. In some embodiments, the protease has an amino acid sequence of SEQ ID NO: 663. In some embodiments, the protease has an amino acid sequence of SEQ ID NO: 664. In some embodiments, the protease has an amino acid sequence of SEQ ID NO: 665. In some embodiments, the protease has an amino acid sequence of SEQ ID NO: 666. In some embodiments, the protease has an amino acid sequence of SEQ ID NO: 667. In some embodiments, the protease has an amino acid sequence of SEQ ID NO: 668. In some embodiments, the protease has an amino acid sequence of SEQ ID NO: 669. In some embodiments, the protease has an amino acid sequence of SEQ ID NO: 670. In some embodiments, the protease has an amino acid sequence of SEQ ID NO: 671. In some embodiments, the protease has an amino acid sequence of SEQ ID NO: 672. In some embodiments, the protease has an amino acid sequence of SEQ ID NO: 673. In some embodiments, the protease has an amino acid sequence of SEQ ID NO: 674. In some embodiments, the protease has an amino acid sequence of SEQ ID NO: 675. In some embodiments, the protease has an amino acid sequence of SEQ ID NO: 676. In some embodiments, the protease has an amino acid sequence of SEQ ID NO: 677. In some embodiments, the protease has an amino acid sequence of SEQ ID NO: 678. In some embodiments, the protease has an amino acid sequence of SEQ ID NO: 679. In some embodiments, the protease has an amino acid sequence of SEQ ID NO: 680. In some embodiments, the protease has an amino acid sequence of SEQ ID NO: 681. In some embodiments, the protease has an amino acid sequence of SEQ ID NO: 682. In some embodiments, the protease has an amino acid sequence of SEQ ID NO: 683. In some embodiments, the protease has an amino acid sequence of SEQ ID NO: 684. In some embodiments, the protease has an amino acid sequence of SEQ ID NO: 685. In some embodiments, the protease has an amino acid sequence of SEQ ID NO: 686. In some embodiments, the protease has an amino acid sequence of SEQ ID NO: 687. In some embodiments, the protease has an amino acid sequence of SEQ ID NO: 688. In some embodiments, the protease has an amino acid sequence of SEQ ID NO: 689. In some embodiments, the protease has an amino acid sequence of SEQ ID NO: 690. In some embodiments, the protease has an amino acid sequence of SEQ ID NO: 691. In some embodiments, the protease has an amino acid sequence of SEQ ID NO: 692. In some embodiments, the protease has an amino acid sequence of SEQ ID NO: 693. In some embodiments, the protease has an amino acid sequence of SEQ ID NO: 694. In some embodiments, the protease has an amino acid sequence of SEQ ID NO: 695. In some embodiments, the protease has an amino acid sequence of SEQ ID NO: 696. In some embodiments, the protease has an amino acid sequence of SEQ ID NO: 697. In some embodiments, the protease has an amino acid sequence of SEQ ID NO: 698. In some embodiments, the protease has an amino acid sequence of SEQ ID NO: 699. In some embodiments, the protease has an amino acid sequence of SEQ ID NO: 700. In some embodiments, the protease has an amino acid sequence of SEQ ID NO: 701. In some embodiments, the protease has an amino acid sequence of SEQ ID NO: 702. In some embodiments, the protease has an amino acid sequence of SEQ ID NO: 703. In some embodiments, the protease has an amino acid sequence of SEQ ID NO: 704. In some embodiments, the protease has an amino acid sequence of SEQ ID NO: 705. In some embodiments, the protease has an amino acid sequence of SEQ ID NO: 706. In some embodiments, the protease has an amino acid sequence of SEQ ID NO: 707. In some embodiments, the protease has an amino acid sequence of SEQ ID NO: 708. In some embodiments, the protease has an amino acid sequence of SEQ ID NO: 709. In some embodiments, the protease has an amino acid sequence of SEQ ID NO: 710. In some embodiments, the protease has an amino acid sequence of SEQ ID NO: 711. In some embodiments, the protease has an amino acid sequence of SEQ ID NO: 712. In some embodiments, the protease has an amino acid sequence of SEQ ID NO: 713. In some embodiments, the protease has an amino acid sequence of SEQ ID NO: 714. In some embodiments, the protease has an amino acid sequence of SEQ ID NO: 715. In some embodiments, the protease has an amino acid sequence of SEQ ID NO: 716. In some embodiments, the protease has an amino acid sequence of SEQ ID NO: 717. In some embodiments, the protease has an amino acid sequence of SEQ ID NO: 718. In some embodiments, the protease has an amino acid sequence of SEQ ID NO: 719. In some embodiments, the protease has an amino acid sequence of SEQ ID NO: 720. In some embodiments, the protease has an amino acid sequence of SEQ ID NO: 721. In some embodiments, the protease has an amino acid sequence of SEQ ID NO: 722. In some embodiments, the protease has an amino acid sequence of SEQ ID NO: 723. In some embodiments, the protease has an amino acid sequence of SEQ ID NO: 724. In some embodiments, the protease has an amino acid sequence of SEQ ID NO: 725. In some embodiments, the protease has an amino acid sequence of SEQ ID NO: 726. In some embodiments, the protease has an amino acid sequence of SEQ ID NO: 727. In some embodiments, the protease has an amino acid sequence of SEQ ID NO: 728. In some embodiments, the protease has an amino acid sequence of SEQ ID NO: 729. In some embodiments, the protease has an amino acid sequence of SEQ ID NO: 730. In some embodiments, the protease has an amino acid sequence of SEQ ID NO: 731. In some embodiments, the protease has an amino acid sequence of SEQ ID NO: 732. In some embodiments, the protease has an amino acid sequence of SEQ ID NO: 733. In some embodiments, the protease has an amino acid sequence of SEQ ID NO: 734. In some embodiments, the protease has an amino acid sequence of SEQ ID NO: 735. In some embodiments, the protease has an amino acid sequence of SEQ ID NO: 736. In some embodiments, the protease has an amino acid sequence of SEQ ID NO: 737. In some embodiments, the protease has an amino acid sequence of SEQ ID NO: 738. In some embodiments, the protease has an amino acid sequence of SEQ ID NO: 739. In some embodiments, the protease has an amino acid sequence of SEQ ID NO: 740. In some embodiments, the protease has an amino acid sequence of SEQ ID NO: 741. In some embodiments, the protease has an amino acid sequence of SEQ ID NO: 742. In some embodiments, the protease has an amino acid sequence of SEQ ID NO: 743. In some embodiments, the protease has an amino acid sequence of SEQ ID NO: 744. In some embodiments, the protease has an amino acid sequence of SEQ ID NO: 745. In some embodiments, the protease has an amino acid sequence of SEQ ID NO: 746. In some embodiments, the protease has an amino acid sequence of SEQ ID NO: 747. In some embodiments, the protease has an amino acid sequence of SEQ ID NO: 748. In some embodiments, the protease has an amino acid sequence of SEQ ID NO: 749. In some embodiments, the protease has an amino acid sequence of SEQ ID NO: 750. In some embodiments, the protease has an amino acid sequence of SEQ ID NO: 751. In some embodiments, the protease has an amino acid sequence of SEQ ID NO: 752. In some embodiments, the protease has an amino acid sequence of SEQ ID NO: 753. In some embodiments, the protease has an amino acid sequence of SEQ ID NO: 754. In some embodiments, the protease has an amino acid sequence of SEQ ID NO: 755. In some embodiments, the protease has an amino acid sequence of SEQ ID NO: 756. In some embodiments, the protease has an amino acid sequence of SEQ ID NO: 757. In some embodiments, the protease has an amino acid sequence of SEQ ID NO: 758. In some embodiments, the protease has an amino acid sequence of SEQ ID NO: 759. In some embodiments, the protease has an amino acid sequence of SEQ ID NO: 760. In some embodiments, the protease has an amino acid sequence of SEQ ID NO: 761. In some embodiments, the protease has an amino acid sequence of SEQ ID NO: 762. In some embodiments, the protease has an amino acid sequence of SEQ ID NO: 763. In some embodiments, the protease has an amino acid sequence of SEQ ID NO: 764. In some embodiments, the protease has an amino acid sequence of SEQ ID NO: 765. In some embodiments, the protease has an amino acid sequence of SEQ ID NO: 766. In some embodiments, the protease has an amino acid sequence of SEQ ID NO: 767. In some embodiments, the protease has an amino acid sequence of SEQ ID NO: 768. In some embodiments, the protease has an amino acid sequence of SEQ ID NO: 769. In some embodiments, the protease has an amino acid sequence of SEQ ID NO: 770. In some embodiments, the protease has an amino acid sequence of SEQ ID NO: 771. In some embodiments, the protease has an amino acid sequence of SEQ ID NO: 772. In some embodiments, the protease has an amino acid sequence of SEQ ID NO: 773. In some embodiments, the protease has an amino acid sequence of SEQ ID NO: 774. In some embodiments, the protease has an amino acid sequence of SEQ ID NO: 775. In some embodiments, the protease has an amino acid sequence of SEQ ID NO: 776. In some embodiments, the protease has an amino acid sequence of SEQ ID NO: 777. In some embodiments, the protease has an amino acid sequence of SEQ ID NO: 778. In some embodiments, the protease has an amino acid sequence of SEQ ID NO: 779. In some embodiments, the protease has an amino acid sequence of SEQ ID NO: 780. In some embodiments, the protease has an amino acid sequence of SEQ ID NO: 781. In some embodiments, the protease has an amino acid sequence of SEQ ID NO: 782. In some embodiments, the protease has an amino acid sequence of SEQ ID NO: 783. In some embodiments, the protease has an amino acid sequence of SEQ ID NO: 784. In some embodiments, the protease has an amino acid sequence of SEQ ID NO: 785. In some embodiments, the protease has an amino acid sequence of SEQ ID NO: 786. In some embodiments, the protease has an amino acid sequence of SEQ ID NO: 787. In some embodiments, the protease has an amino acid sequence of SEQ ID NO: 788. In some embodiments, the protease has an amino acid sequence of SEQ ID NO: 789. In some embodiments, the protease has an amino acid sequence of SEQ ID NO: 790. In some embodiments, the protease has an amino acid sequence of SEQ ID NO: 791. In some embodiments, the protease has an amino acid sequence of SEQ ID NO: 792. In some embodiments, the protease has an amino acid sequence of SEQ ID NO: 793. In some embodiments, the protease has an amino acid sequence of SEQ ID NO: 794. In some embodiments, the protease has an amino acid sequence of SEQ ID NO: 795. In some embodiments, the protease has an amino acid sequence of SEQ ID NO: 796. In some embodiments, the protease has an amino acid sequence of SEQ ID NO: 797. In some embodiments, the protease has an amino acid sequence of SEQ ID NO: 798. In some embodiments, the protease has an amino acid sequence of SEQ ID NO: 799. In some embodiments, the protease has an amino acid sequence of SEQ ID NO: 800. In some embodiments, the protease has an amino acid sequence of SEQ ID NO: 801. In some embodiments, the protease has an amino acid sequence of SEQ ID NO: 802. In some embodiments, the protease has an amino acid sequence of SEQ ID NO: 803. In some embodiments, the protease has an amino acid sequence of SEQ ID NO: 804. In some embodiments, the protease has an amino acid sequence of SEQ ID NO: 805. In some embodiments, the protease has an amino acid sequence of SEQ ID NO: 806. In some embodiments, the protease has an amino acid sequence of SEQ ID NO: 807. In some embodiments, the protease has an amino acid sequence of SEQ ID NO: 808. In some embodiments, the protease has an amino acid sequence of SEQ ID NO: 809. In some embodiments, the protease has an amino acid sequence of SEQ ID NO: 810. In some embodiments, the protease has an amino acid sequence of SEQ ID NO: 811. In some embodiments, the protease has an amino acid sequence of SEQ ID NO: 812. In some embodiments, the protease has an amino acid sequence of SEQ ID NO: 813.

In some embodiments, the protease has an amino acid sequence of SEQ ID NO: 814. In some embodiments, the protease has an amino acid sequence of SEQ ID NO: 815. In some embodiments, the protease has an amino acid sequence of SEQ ID NO: 816. In some embodiments, the protease has an amino acid sequence of SEQ ID NO: 817. In some embodiments, the protease has an amino acid sequence of SEQ ID NO: 818. In some embodiments, the protease has an amino acid sequence of SEQ ID NO: 819. In some embodiments, the protease has an amino acid sequence of SEQ ID NO: 820. In some embodiments, the protease has an amino acid sequence of SEQ ID NO: 821. In some embodiments, the protease has an amino acid sequence of SEQ ID NO: 822. In some embodiments, the protease has an amino acid sequence of SEQ ID NO: 823. In some embodiments, the protease has an amino acid sequence of SEQ ID NO: 824. In some embodiments, the protease has an amino acid sequence of SEQ ID NO: 825. In some embodiments, the protease has an amino acid sequence of SEQ ID NO: 826. In some embodiments, the protease has an amino acid sequence of SEQ ID NO: 827. In some embodiments, the protease has an amino acid sequence of SEQ ID NO: 828. In some embodiments, the protease has an amino acid sequence of SEQ ID NO: 829. In some embodiments, the protease has an amino acid sequence of SEQ ID NO: 830. In some embodiments, the protease has an amino acid sequence of SEQ ID NO: 831. In some embodiments, the protease has an amino acid sequence of SEQ ID NO: 832. In some embodiments, the protease has an amino acid sequence of SEQ ID NO: 833. In some embodiments, the protease has an amino acid sequence of SEQ ID NO: 834. In some embodiments, the protease has an amino acid sequence of SEQ ID NO: 835. In some embodiments, the protease has an amino acid sequence of SEQ ID NO: 836. In some embodiments, the protease has an amino acid sequence of SEQ ID NO: 837. In some embodiments, the protease has an amino acid sequence of SEQ ID NO: 838. In some embodiments, the protease has an amino acid sequence of SEQ ID NO: 839. In some embodiments, the protease has an amino acid sequence of SEQ ID NO: 840. In some embodiments, the protease has an amino acid sequence of SEQ ID NO: 841. In some embodiments, the protease has an amino acid sequence of SEQ ID NO: 842. In some embodiments, the protease has an amino acid sequence of SEQ ID NO: 843. In some embodiments, the protease has an amino acid sequence of SEQ ID NO: 844. In some embodiments, the protease has an amino acid sequence of SEQ ID NO: 845. In some embodiments, the protease has an amino acid sequence of SEQ ID NO: 846. In some embodiments, the protease has an amino acid sequence of SEQ ID NO: 847. In some embodiments, the protease has an amino acid sequence of SEQ ID NO: 848. In some embodiments, the protease has an amino acid sequence of SEQ ID NO: 849. In some embodiments, the protease has an amino acid sequence of SEQ ID NO: 850. In some embodiments, the protease has an amino acid sequence of SEQ ID NO: 851. In some embodiments, the protease has an amino acid sequence of SEQ ID NO: 852. In some embodiments, the protease has an amino acid sequence of SEQ ID NO: 853. In some embodiments, the protease has an amino acid sequence of SEQ ID NO: 854. In some embodiments, the protease has an amino acid sequence of SEQ ID NO: 855. In some embodiments, the protease has an amino acid sequence of SEQ ID NO: 856. In some embodiments, the protease has an amino acid sequence of SEQ ID NO: 857. In some embodiments, the protease has an amino acid sequence of SEQ ID NO: 858. In some embodiments, the protease has an amino acid sequence of SEQ ID NO: 859. In some embodiments, the protease has an amino acid sequence of SEQ ID NO: 860. In some embodiments, the protease has an amino acid sequence of SEQ ID NO: 861. In some embodiments, the protease has an amino acid sequence of SEQ ID NO: 862. In some embodiments, the protease has an amino acid sequence of SEQ ID NO: 863. In some embodiments, the protease has an amino acid sequence of SEQ ID NO: 864. In some embodiments, the protease has an amino acid sequence of SEQ ID NO: 865. In some embodiments, the protease has an amino acid sequence of SEQ ID NO: 866. In some embodiments, the protease has an amino acid sequence of SEQ ID NO: 867. In some embodiments, the protease has an amino acid sequence of SEQ ID NO: 868. In some embodiments, the protease has an amino acid sequence of SEQ ID NO: 869. In some embodiments, the protease has an amino acid sequence of SEQ ID NO: 870. In some embodiments, the protease has an amino acid sequence of SEQ ID NO: 871. In some embodiments, the protease has an amino acid sequence of SEQ ID NO: 872. In some embodiments, the protease has an amino acid sequence of SEQ ID NO: 873. In some embodiments, the protease has an amino acid sequence of SEQ ID NO: 874. In some embodiments, the protease has an amino acid sequence of SEQ ID NO: 875. In some embodiments, the protease has an amino acid sequence of SEQ ID NO: 876. In some embodiments, the protease has an amino acid sequence of SEQ ID NO: 877. In some embodiments, the protease has an amino acid sequence of SEQ ID NO: 878. In some embodiments, the protease has an amino acid sequence of SEQ ID NO: 879. In some embodiments, the protease has an amino acid sequence of SEQ ID NO: 880. In some embodiments, the protease has an amino acid sequence of SEQ ID NO: 881. In some embodiments, the protease has an amino acid sequence of SEQ ID NO: 882. In some embodiments, the protease has an amino acid sequence of SEQ ID NO: 883. In some embodiments, the protease has an amino acid sequence of SEQ ID NO: 884. In some embodiments, the protease has an amino acid sequence of SEQ ID NO: 885. In some embodiments, the protease has an amino acid sequence of SEQ ID NO: 886. In some embodiments, the protease has an amino acid sequence of SEQ ID NO: 887. In some embodiments, the protease has an amino acid sequence of SEQ ID NO: 888. In some embodiments, the protease has an amino acid sequence of SEQ ID NO: 889. In some embodiments, the protease has an amino acid sequence of SEQ ID NO: 890. In some embodiments, the protease has an amino acid sequence of SEQ ID NO: 891. In some embodiments, the protease has an amino acid sequence of SEQ ID NO: 892. In some embodiments, the protease has an amino acid sequence of SEQ ID NO: 893. In some embodiments, the protease has an amino acid sequence of SEQ ID NO: 894. In some embodiments, the protease has an amino acid sequence of SEQ ID NO: 895. In some embodiments, the protease has an amino acid sequence of SEQ ID NO: 896. In some embodiments, the protease has an amino acid sequence of SEQ ID NO: 897. In some embodiments, the protease has an amino acid sequence of SEQ ID NO: 898. In some embodiments, the protease has an amino acid sequence of SEQ ID NO: 899. In some embodiments, the protease has an amino acid sequence of SEQ ID NO: 900. In some embodiments, the protease has an amino acid sequence of SEQ ID NO: 901. In some embodiments, the protease has an amino acid sequence of SEQ ID NO: 902. In some embodiments, the protease has an amino acid sequence of SEQ ID NO: 903. In some embodiments, the protease has an amino acid sequence of SEQ ID NO: 904. In some embodiments, the protease has an amino acid sequence of SEQ ID NO: 905. In some embodiments, the protease has an amino acid sequence of SEQ ID NO: 906. In some embodiments, the protease has an amino acid sequence of SEQ ID NO: 907. In some embodiments, the protease has an amino acid sequence of SEQ ID NO: 908. In some embodiments, the protease has an amino acid sequence of SEQ ID NO: 909. In some embodiments, the protease has an amino acid sequence of SEQ ID NO: 910. In some embodiments, the protease has an amino acid sequence of SEQ ID NO: 911. In some embodiments, the protease has an amino acid sequence of SEQ ID NO: 912. In some embodiments, the protease has an amino acid sequence of SEQ ID NO: 913. In some embodiments, the protease has an amino acid sequence of SEQ ID NO: 914. In some embodiments, the protease has an amino acid sequence of SEQ ID NO: 915. In some embodiments, the protease has an amino acid sequence of SEQ ID NO: 916. In some embodiments, the protease has an amino acid sequence of SEQ ID NO: 917. In some embodiments, the protease has an amino acid sequence of SEQ ID NO: 918. In some embodiments, the protease has an amino acid sequence of SEQ ID NO: 919. In some embodiments, the protease has an amino acid sequence of SEQ ID NO: 920. In some embodiments, the protease has an amino acid sequence of SEQ ID NO: 921. In some embodiments, the protease has an amino acid sequence of SEQ ID NO: 922. In some embodiments, the protease has an amino acid sequence of SEQ ID NO: 923. In some embodiments, the protease has an amino acid sequence of SEQ ID NO: 924. In some embodiments, the protease has an amino acid sequence of SEQ ID NO: 925. In some embodiments, the protease has an amino acid sequence of SEQ ID NO: 926. In some embodiments, the protease has an amino acid sequence of SEQ ID NO: 927. In some embodiments, the protease has an amino acid sequence of SEQ ID NO: 928. In some embodiments, the protease has an amino acid sequence of SEQ ID NO: 929. In some embodiments, the protease has an amino acid sequence of SEQ ID NO: 930. In some embodiments, the protease has an amino acid sequence of SEQ ID NO: 931. In some embodiments, the protease has an amino acid sequence of SEQ ID NO: 932. In some embodiments, the protease has an amino acid sequence of SEQ ID NO: 933. In some embodiments, the protease has an amino acid sequence of SEQ ID NO: 934. In some embodiments, the protease has an amino acid sequence of SEQ ID NO: 935. In some embodiments, the protease has an amino acid sequence of SEQ ID NO: 936. In some embodiments, the protease has an amino acid sequence of SEQ ID NO: 937. In some embodiments, the protease has an amino acid sequence of SEQ ID NO: 938. In some embodiments, the protease has an amino acid sequence of SEQ ID NO: 939. In some embodiments, the protease has an amino acid sequence of SEQ ID NO: 940. In some embodiments, the protease has an amino acid sequence of SEQ ID NO: 941. In some embodiments, the protease has an amino acid sequence of SEQ ID NO: 942. In some embodiments, the protease has an amino acid sequence of SEQ ID NO: 943. In some embodiments, the protease has an amino acid sequence of SEQ ID NO: 944. In some embodiments, the protease has an amino acid sequence of SEQ ID NO: 945. In some embodiments, the protease has an amino acid sequence of SEQ ID NO: 946. In some embodiments, the protease has an amino acid sequence of SEQ ID NO: 947. In some embodiments, the protease has an amino acid sequence of SEQ ID NO: 948. In some embodiments, the protease has an amino acid sequence of SEQ ID NO: 949. In some embodiments, the protease has an amino acid sequence of SEQ ID NO: 950. In some embodiments, the protease has an amino acid sequence of SEQ ID NO: 951. In some embodiments, the protease has an amino acid sequence of SEQ ID NO: 952. In some embodiments, the protease has an amino acid sequence of SEQ ID NO: 953. In some embodiments, the protease has an amino acid sequence of SEQ ID NO: 954. In some embodiments, the protease has an amino acid sequence of SEQ ID NO: 955. In some embodiments, the protease has an amino acid sequence of SEQ ID NO: 956. In some embodiments, the protease has an amino acid sequence of SEQ ID NO: 957. In some embodiments, the protease has an amino acid sequence of SEQ ID NO: 958. In some embodiments, the protease has an amino acid sequence of SEQ ID NO: 959. In some embodiments, the protease has an amino acid sequence of SEQ ID NO: 960. In some embodiments, the protease has an amino acid sequence of SEQ ID NO: 961. In some embodiments, the protease has an amino acid sequence of SEQ ID NO: 962. In some embodiments, the protease has an amino acid sequence of SEQ ID NO: 963. In some embodiments, the protease has an amino acid sequence of SEQ ID NO: 964. In some embodiments, the protease has an amino acid sequence of SEQ ID NO: 965. In some embodiments, the protease has an amino acid sequence of SEQ ID NO: 966. In some embodiments, the protease has an amino acid sequence of SEQ ID NO: 967. In some embodiments, the protease has an amino acid sequence of SEQ ID NO: 968. In some embodiments, the protease has an amino acid sequence of SEQ ID NO: 969. In some embodiments, the protease has an amino acid sequence of SEQ ID NO: 970. In some embodiments, the protease has an amino acid sequence of SEQ ID NO: 971. In some embodiments, the protease has an amino acid sequence of SEQ ID NO: 972. In some embodiments, the protease has an amino acid sequence of SEQ ID NO: 973. In some embodiments, the protease has an amino acid sequence of SEQ ID NO: 974. In some embodiments, the protease has an amino acid sequence of SEQ ID NO: 975. In some embodiments, the protease has an amino acid sequence of SEQ ID NO: 976. In some embodiments, the protease has an amino acid sequence of SEQ ID NO: 977. In some embodiments, the protease has an amino acid sequence of SEQ ID NO: 978. In some embodiments, the protease has an amino acid sequence of SEQ ID NO: 979. In some embodiments, the protease has an amino acid sequence of SEQ ID NO: 980. In some embodiments, the protease has an amino acid sequence of SEQ ID NO: 981. In some embodiments, the protease has an amino acid sequence of SEQ ID NO: 982. In some embodiments, the protease has an amino acid sequence of SEQ ID NO: 983. In some embodiments, the protease has an amino acid sequence of SEQ ID NO: 984. In some embodiments, the protease has an amino acid sequence of SEQ ID NO: 985. In some embodiments, the protease has an amino acid sequence of SEQ ID NO: 986. In some embodiments, the protease has an amino acid sequence of SEQ ID NO: 987. In some embodiments, the protease has an amino acid sequence of SEQ ID NO: 988. In some embodiments, the protease has an amino acid sequence of SEQ ID NO: 989. In some embodiments, the protease has an amino acid sequence of SEQ ID NO: 990. In some embodiments, the protease has an amino acid sequence of SEQ ID NO: 991. In some embodiments, the protease has an amino acid sequence of SEQ ID NO: 992. In some embodiments, the protease has an amino acid sequence of SEQ ID NO: 993. In some embodiments, the protease has an amino acid sequence of SEQ ID NO: 994. In some embodiments, the protease has an amino acid sequence of SEQ ID NO: 995. In some embodiments, the protease has an amino acid sequence of SEQ ID NO: 996. In some embodiments, the protease has an amino acid sequence of SEQ ID NO: 997. In some embodiments, the protease has an amino acid sequence of SEQ ID NO: 998. In some embodiments, the protease has an amino acid sequence of SEQ ID NO: 999. In some embodiments, the protease has an amino acid sequence of SEQ ID NO: 1000. In some embodiments, the protease has an amino acid sequence of SEQ ID NO: 1001. In some embodiments, the protease has an amino acid sequence of SEQ ID NO: 1002. In some embodiments, the protease has an amino acid sequence of SEQ ID NO: 1003. In some embodiments, the protease has an amino acid sequence of SEQ ID NO: 1004. In some embodiments, the protease has an amino acid sequence of SEQ ID NO: 1005. In some embodiments, the protease has an amino acid sequence of SEQ ID NO: 1006. In some embodiments, the protease has an amino acid sequence of SEQ ID NO: 1007. In some embodiments, the protease has an amino acid sequence of SEQ ID NO: 1008. In some embodiments, the protease has an amino acid sequence of SEQ ID NO: 1009. In some embodiments, the protease has an amino acid sequence of SEQ ID NO: 1010. In some embodiments, the protease has an amino acid sequence of SEQ ID NO: 1011. In some embodiments, the protease has an amino acid sequence of SEQ ID NO: 1012. In some embodiments, the protease has an amino acid sequence of SEQ ID NO: 1013. In some embodiments, the protease has an amino acid sequence of SEQ ID NO: 1014. In some embodiments, the protease has an amino acid sequence of SEQ ID NO: 1015. In some embodiments, the protease has an amino acid sequence of SEQ ID NO: 1016. In some embodiments, the protease has an amino acid sequence of SEQ ID NO: 1017. In some embodiments, the protease has an amino acid sequence of SEQ ID NO: 1018. In some embodiments, the protease has an amino acid sequence of SEQ ID NO: 1019. In some embodiments, the protease has an amino acid sequence of SEQ ID NO: 1290. In some embodiments, the protease has an amino acid sequence of SEQ ID NO: 1291. In some embodiments, the protease has an amino acid sequence of SEQ ID NO: 1292. In some embodiments, the protease has an amino acid sequence of SEQ ID NO: 1293. In some embodiments, the protease has an amino acid sequence of SEQ ID NO: 1294. In some embodiments, the protease has an amino acid sequence of SEQ ID NO: 1295. In some embodiments, the protease has an amino acid sequence of SEQ ID NO: 1296. In some embodiments, the protease has an amino acid sequence of SEQ ID NO: 1297. In some embodiments, the protease has an amino acid sequence of SEQ ID NO: 1298. In some embodiments, the protease has an amino acid sequence of SEQ ID NO: 1299. In some embodiments, the protease has an amino acid sequence of SEQ ID NO: 1300. In some embodiments, the protease has an amino acid sequence of SEQ ID NO: 1301. In some embodiments, the protease has an amino acid sequence of SEQ ID NO: 1302. In some embodiments, the protease has an amino acid sequence of SEQ ID NO: 1303. In some embodiments, the protease has an amino acid sequence of SEQ ID NO: 1304. In some embodiments, the protease has an amino acid sequence of SEQ ID NO: 1305. In some embodiments, the protease has an amino acid sequence of SEQ ID NO: 1306. In some embodiments, the protease has an amino acid sequence of SEQ ID NO: 1307. In some embodiments, the protease has an amino acid sequence of SEQ ID NO: 1308. In some embodiments, the protease has an amino acid sequence of SEQ ID NO: 1309. In some embodiments, the protease has an amino acid sequence of SEQ ID NO: 1310. In some embodiments, the protease has an amino acid sequence of SEQ ID NO: 1333.

In some embodiments, the protease has an amino acid sequence of any one of SEQ ID NO: 56-752, and optionally does not comprise the methionine (M) residue at the N-terminus of any one of SEQ ID NO: 56-752. For example, the protease having an amino acid sequence of any one of SEQ ID NO: 56-752, and optionally not comprising the methionine (M) residue at the N-terminus of any one of SEQ ID NO: 56-752, comprises the amino acid sequence of any one of SEQ ID NO: 56-752, wherein the amino acid sequence of any one of SEQ ID NO: 56-752 does not comprise the methionine (M) residue at the N-terminus.

In some embodiments, the protease and polypeptides provided for herein comprise a leader sequence that is present at the N-terminus of the polypeptide. Without being bound to any particular theory, leader sequences can facilitate the expression of polypeptides in eukaryotic cells. Any suitable leader sequence can be utilized. For example, leader sequences comprising the sequence of METDTLLLWVLLLWVPGSTG (SEQ ID NO: 1357), or MGWSCIILFLVATATGVHS (SEQ ID NO: 1358) be used. These are non-limiting examples of leader sequences. The leader sequences are processed (removed) from the polypeptide as it is being translated and expressed in the cell leaving the polypeptides provided for herein. Thus, in some embodiments, when present in a pharmaceutical composition or as an isolated polypeptide, the polypeptides provided for herein do not comprise a leader sequence. In some embodiments, polypeptides provided for herein comprise an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 55-1019, 1290-1310 and 1333, and further comprises a leader amino acid sequence. In some embodiments, the protease has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 55-1019, 1290-1310 and 1333, and further comprises a leader amino acid sequence having an amino acid sequence of METDTLLLWVLLLWVPGSTG (SEQ ID NO: 1357), or MGWSCIILFLVATATGVHS (SEQ ID NO: 1358). In some embodiments, the leader amino acid sequence is N-terminal to the protease. In some embodiments, the leader amino acid sequence facilitates expression of the protease. In some embodiments, the leader amino acid sequence is processed and removed from the protease during expression ex vivo or in vivo.

In some embodiments, the protease comprises the polypeptide. In some embodiments, the polypeptide comprises a mutation at any position as compared to SEQ ID NO: 35. In some embodiments, the mutation is a substitution, a deletion, or an insertion. In some embodiments, the mutation is a substitution. Non-limiting examples of positions that may comprise mutations, as compared to SEQ ID NO: 35, are provided in Table 20 below.

In some embodiments, the polypeptide comprises a mutation at any position provided in Table 21, as compared to SEQ ID NO: 35. In some embodiments, the polypeptide comprises a set of mutations at any set of positions provided in Table 21, as compared to SEQ ID NO: 35. In some embodiments, the polypeptide comprises an amino acid sequence having a mutation at any position provided in Table 21, as compared to SEQ ID NO: 35. In some embodiments, the polypeptide comprises an amino acid sequence having a set of mutations at any set of positions provided in Table 21, as compared to SEQ ID NO: 35. In some embodiments, the polypeptide comprises the amino acid sequence having at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 35, provided that the amino acid sequence comprises a mutation at any position, or any set of mutations at any set of positions, provided in Table 20, as compared to SEQ ID NO: 35.

TABLE 20

| Non-limiting examples of positions that may comprise a mutation, or a set of mutations [as compared to SEQ ID NO: 35] | | | | |
|---|---|---|---|---|
| 60 | 61 | 63 | 64 | 74 |
| 76 | 146 | 227 | 229 | 121 |
| 130 | 134 | 154 | 190 | 225 |
| 229 | 258 | 289 | 303 | 336 |
| 85 and 121 | 85 and 130 | 85 and 134 | 85 and 154 | 85 and 190 |
| 85 and 225 | 85 and 229 | 85 and 258 | 85 and 289 | 85 and 303 |
| 85 and 336 | 121 and 130 | 121 and 134 | 121 and 154 | 121 and 190 |
| 121 and 225 | 121 and 229 | 121 and 258 | 121 and 289 | 121 and 303 |
| 121 and 336 | 130 and 134 | 130 and 154 | 130 and 190 | 130 and 225 |
| 130 and 229 | 130 and 258 | 130 and 289 | 130 and 303 | 130 and 336 |
| 134 and 154 | 134 and 190 | 134 and 225 | 134 and 229 | 134 and 258 |
| 134 and 289 | 134 and 303 | 134 and 336 | 154 and 190 | 154 and 225 |
| 154 and 229 | 154 and 258 | 154 and 289 | 154 and 303 | 154 and 336 |
| 190 and 225 | 190 and 229 | 190 and 258 | 190 and 289 | 190 and 303 |
| 190 and 336 | 225 and 229 | 225 and 258 | 225 and 289 | 225 and 303 |
| 225 and 336 | 229 and 258 | 229 and 289 | 229 and 303 | 229 and 336 |
| 258 and 289 | 258 and 303 | 258 and 336 | 289 and 303 | 289 and 336 |
| 303 and 336 | 60 and 61 | 60 and 63 | 60 and 64 | 60 and 74 |
| 60 and 76 | 60 and 146 | 60 and 227 | 60 and 229 | 61 and 63 |
| 61 and 64 | 61 and 74 | 61 and 76 | 61 and 146 | 61 and 227 |
| 61 and 229 | 63 and 64 | 63 and 74 | 63 and 76 | 63 and 146 |
| 63 and 227 | 63 and 229 | 64 and 74 | 64 and 76 | 64 and 146 |
| 64 and 227 | 64 and 229 | 74 and 76 | 74 and 146 | 74 and 227 |
| 74 and 229 | 76 and 146 | 76 and 227 | 76 and 229 | 146 and 227 |
| 146 and 229 | 227 and 229 | 60, 61 and 63 | 60, 61 and 64 | 60, 61 and 74 |
| 60, 61 and 76 | 60, 61 and 146 | 60, 61 and 227 | 60, 61 and 229 | 60, 63 and 64 |
| 60, 63 and 74 | 60, 63 and 76 | 60, 63 and 146 | 60, 63 and 227 | 60, 63 and 229 |
| 60, 64 and 74 | 60, 64 and 76 | 60, 64 and 146 | 60, 64 and 227 | 60, 64 and 229 |
| 60, 74 and 76 | 60, 74 and 146 | 60, 74 and 227 | 60, 74 and 229 | 60, 76 and 146 |
| 60, 76 and 227 | 60, 76 and 229 | 60, 146 and 227 | 60, 146 and 229 | 60, 227 and 229 |
| 61, 63 and 64 | 61, 63 and 74 | 61, 63 and 76 | 61, 63 and 146 | 61, 63 and 227 |
| 61, 63 and 229 | 61, 64 and 74 | 61, 64 and 76 | 61, 64 and 146 | 61, 64 and 227 |
| 61, 64 and 229 | 61, 74 and 76 | 61, 74 and 146 | 61, 74 and 227 | 61, 74 and 229 |
| 61, 76 and 146 | 61, 76 and 227 | 61, 76 and 229 | 61, 146 and 227 | 61, 146 and 229 |
| 61, 227 and 229 | 63, 64 and 74 | 63, 64 and 76 | 63, 64 and 146 | 63, 64 and 227 |
| 63, 64 and 229 | 63, 74 and 76 | 63, 74 and 146 | 63, 74 and 227 | 63, 74 and 229 |
| 63, 76 and 146 | 63, 76 and 227 | 63, 76 and 229 | 63, 146 and 227 | 63, 146 and 229 |
| 63, 227 and 229 | 64, 74 and 76 | 64, 74 and 146 | 64, 74 and 227 | 64, 74 and 229 |
| 64, 76 and 146 | 64, 76 and 227 | 64, 76 and 229 | 64, 146 and 227 | 64, 146 and 229 |
| 64, 227 and 229 | 74, 76 and 146 | 74, 76 and 227 | 74, 76 and 229 | 74, 146 and 227 |
| 74, 146 and 229 | 74, 227 and 229 | 76, 146 and 227 | 76, 146 and 229 | 76, 227 and 229 |
| 146, 227 and 229 | 85, 121 and 134 | 85, 121 and 154 | 85, 121 and 190 | 85, 121 and 225 |
| 85, 121 and 229 | 85, 121 and 258 | 85, 121 and 289 | 85, 121 and 303 | 85, 121 and 336 |
| 85, 130 and 134 | 85, 130 and 154 | 85, 130 and 190 | 85, 130 and 225 | 85, 130 and 229 |
| 85, 130 and 258 | 85, 130 and 289 | 85, 130 and 303 | 85, 130 and 336 | 85, 134 and 154 |
| 85, 134 and 190 | 85, 134 and 225 | 85, 134 and 229 | 85, 134 and 258 | 85, 134 and 289 |
| 85, 134 and 303 | 85, 134 and 336 | 85, 154 and 190 | 85, 154 and 225 | 85, 154 and 229 |
| 85, 154 and 258 | 85, 154 and 289 | 85, 154 and 303 | 85, 154 and 336 | 85, 190 and 225 |
| 85, 190 and 229 | 85, 190 and 258 | 85, 190 and 289 | 85, 190 and 303 | 85, 190 and 336 |
| 85, 225 and 229 | 85, 225 and 258 | 85, 225 and 289 | 85, 225 and 303 | 85, 225 and 336 |
| 85, 229 and 258 | 85, 229 and 289 | 85, 229 and 303 | 85, 229 and 336 | 85, 258 and 289 |
| 85, 258 and 303 | 85, 258 and 336 | 85, 289 and 303 | 85, 289 and 336 | 85, 303 and 336 |
| 121, 130 and 134 | 121, 130 and 154 | 121, 130 and 190 | 121, 130 and 225 | 121, 130 and 229 |
| 121, 130 and 258 | 121, 130 and 289 | 121, 130 and 303 | 121, 130 and 336 | 121, 134 and 154 |
| 121, 134 and 190 | 121, 134 and 225 | 121, 134 and 229 | 121, 134 and 258 | 121, 134 and 289 |
| 121, 134 and 303 | 121, 134 and 336 | 121, 154 and 190 | 121, 154 and 225 | 121, 154 and 229 |
| 121, 154 and 258 | 121, 154 and 289 | 121, 154 and 303 | 121, 154 and 336 | 121, 190 and 225 |
| 121, 190 and 229 | 121, 190 and 258 | 121, 190 and 289 | 121, 190 and 303 | 121, 190 and 336 |
| 121, 225 and 229 | 121, 225 and 258 | 121, 225 and 289 | 121, 225 and 303 | 121, 225 and 336 |
| 121, 229 and 258 | 121, 229 and 289 | 121, 229 and 303 | 121, 229 and 336 | 121, 258 and 289 |
| 121, 258 and 303 | 121, 258 and 336 | 121, 289 and 303 | 121, 289 and 336 | 121, 303 and 336 |

TABLE 20-continued

| Non-limiting examples of positions that may comprise a mutation, or a set of mutations [as compared to SEQ ID NO: 35] | | | | |
|---|---|---|---|---|
| 130, 134 and 154 | 130, 134 and 190 | 130, 134 and 225 | 130, 134 and 229 | 130, 134 and 258 |
| 130, 134 and 289 | 130, 134 and 303 | 130, 134 and 336 | 130, 154 and 190 | 130, 154 and 225 |
| 130, 154 and 229 | 130, 154 and 258 | 130, 154 and 289 | 130, 154 and 303 | 130, 154 and 336 |
| 130, 190 and 225 | 130, 190 and 229 | 130, 190 and 258 | 130, 190 and 289 | 130, 190 and 303 |
| 130, 190 and 336 | 130, 225 and 229 | 130, 225 and 258 | 130, 225 and 289 | 130, 225 and 303 |
| 130, 225 and 336 | 130, 229 and 258 | 130, 229 and 289 | 130, 229 and 303 | 130, 229 and 336 |
| 130, 258 and 289 | 130, 258 and 303 | 130, 258 and 336 | 130, 289 and 303 | 130, 289 and 336 |
| 130, 303 and 336 | 134, 154 and 190 | 134, 154 and 225 | 134, 154 and 229 | 134, 154 and 258 |
| 134, 154 and 289 | 134, 154 and 303 | 134, 154 and 336 | 134, 190 and 225 | 134, 190, and 229 |
| 134, 190 and 258 | 134, 190 and 289 | 134, 190 and 303 | 134, 190 and 336 | 134, 225 and 229 |
| 134, 225 and 258 | 134, 225 and 289 | 134, 225 and 303 | 134, 225 and 336 | 134, 229 and 258 |
| 134, 229 and 289 | 134, 229 and 303 | 134, 229 and 336 | 134, 258 and 289 | 134, 258 and 303 |
| 134, 258 and 336 | 134, 289 and 303 | 134, 289 and 336 | 134, 303 and 336 | 154, 190 and 225 |
| 154, 190 and 229 | 154, 190 and 258 | 154, 190 and 289 | 154, 190 and 303 | 154, 190 and 336 |
| 154, 225 and 229 | 154, 225 and 258 | 154, 225 and 289 | 154, 225 and 303 | 154, 225 and 336 |
| 154, 229 and 258 | 154, 229 and 289 | 154, 229 and 303 | 154, 229 and 336 | 154, 258 and 289 |
| 154, 258 and 303 | 154, 258 and 336 | 154, 289 and 303 | 154, 289 and 336 | 154, 303 and 336 |
| 190, 225 and 229 | 190, 225 and 258 | 190, 225 and 289 | 190, 225 and 303 | 190, 225 and 336 |
| 190, 229 and 258 | 190, 229 and 289 | 190, 229 and 303 | 190, 229 and 336 | 190, 258 and 289 |
| 190, 258 and 303 | 190, 258 and 336 | 190, 289 and 303 | 190, 289 and 336 | 190, 303 and 336 |
| 225, 229 and 258 | 225, 229 and 289 | 225, 229 and 303 | 225, 229 and 336 | 225, 258 and 289 |
| 225, 258 and 303 | 225, 258 and 336 | 225, 289 and 303 | 225, 289 and 336 | 225, 303 and 336 |
| 229, 258 and 289 | 229, 258 and 303 | 229, 258 and 336 | 229, 289 and 303 | 229, 289 and 336 |
| 229, 303 and 336 | 258, 289 and 303 | 258, 289 and 336 | 258, 303 and 336 | 289, 303 and 336 |
| 85, 121, 130 and 134 | 85, 121, 130 and 154 | 85, 121, 130 and 190 | 85, 121, 130 and 225 | 85, 121, 130 and 229 |
| 85, 121, 130 and 258 | 85, 121, 130 and 289 | 85, 121, 130 and 303 | 85, 121, 130 and 336 | 85, 121, 134 and 154 |
| 85, 121, 134 and 190 | 85, 121, 134 and 225 | 85, 121, 134 and 229 | 85, 121, 134 and 258 | 85, 121, 134 and 289 |
| 85, 121, 134 and 303 | 85, 121, 134 and 336 | 85, 121, 154 and 190 | 85, 121, 154 and 225 | 85, 121, 154 and 229 |
| 85, 121, 154 and 258 | 85, 121, 154 and 289 | 85, 121, 154 and 303 | 85, 121, 154 and 336 | 85, 121, 190 and 225 |
| 85, 121, 190 and 229 | 85, 121, 190 and 258 | 85, 121, 190 and 289 | 85, 121, 190 and 303 | 85, 121, 190 and 336 |
| 85, 121, 225 and 229 | 85, 121, 225 and 258 | 85, 121, 225 and 289 | 85, 121, 225 and 303 | 85, 121, 225 and 336 |
| 85, 121, 229 and 258 | 85, 121, 229 and 289 | 85, 121, 229 and 303 | 85, 121, 229 and 336 | 85, 121, 258 and 289 |
| 85, 121, 258 and 303 | 85, 121, 258 and 336 | 85, 121, 289 and 303 | 85, 121, 289 and 336 | 85, 121, 303 and 336 |
| 85, 130, 134 and 154 | 85, 130, 134 and 190 | 85, 130, 134 and 225 | 85, 130, 134 and 229 | 85, 130, 134 and 258 |
| 85, 130, 134 and 289 | 85, 130, 134 and 303 | 85, 130, 134 and 336 | 85, 130, 154 and 190 | 85, 130, 154 and 225 |
| 85, 130, 154 and 229 | 85, 130, 154 and 258 | 85, 130, 154 and 289 | 85, 130, 154 and 303 | 85, 130, 154 and 336 |
| 85, 130, 190 and 225 | 85, 130, 190 and 229 | 85, 130, 190 and 258 | 85, 130, 190 and 289 | 85, 130, 190 and 303 |
| 85, 130, 190 and 336 | 85, 130, 225 and 229 | 85, 130, 225 and 258 | 85, 130, 225 and 289 | 85, 130, 225 and 303 |
| 85, 130, 225 and 336 | 85, 130, 229 and 258 | 85, 130, 229 and 289 | 85, 130, 229 and 303 | 85, 130, 229 and 336 |
| 85, 130, 258 and 289 | 85, 130, 258 and 303 | 85, 130, 258 and 336 | 85, 130, 289 and 303 | 85, 130, 289 and 336 |
| 85, 130, 303 and 336 | 85, 134, 154 and 190 | 85, 134, 154 and 225 | 85, 134, 154 and 229 | 85, 134, 154 and 258 |
| 85, 134, 154 and 289 | 85, 134, 154 and 303 | 85, 134, 154 and 336 | 85, 134, 190 and 225 | 85, 134, 190 and 229 |
| 85, 134, 190 and 258 | 85, 134, 190 and 289 | 85, 134, 190 and 303 | 85, 134, 190 and 336 | 85, 134, 225 and 229 |
| 85, 134, 225 and 258 | 85, 134, 225 and 289 | 85, 134, 225 and 303 | 85, 134, 225 and 336 | 85, 134, 229 and 258 |
| 85, 134, 229 and 289 | 85, 134, 229 and 303 | 85, 134, 229 and 336 | 85, 134, 258 and 289 | 85, 134, 258 and 303 |
| 85, 134, 258 and 336 | 85, 134, 289 and 303 | 85, 134, 289 and 336 | 85, 134, 303 and 336 | 85, 154, 190 and 225 |
| 85, 154, 190 and 229 | 85, 154, 190 and 258 | 85, 154, 190 and 289 | 85, 154, 190 and 303 | 85, 154, 190 and 336 |
| 85, 154, 225 and 229 | 85, 154, 225 and 258 | 85, 154, 225 and 289 | 85, 154, 225 and 303 | 85, 154, 225 and 336 |
| 85, 154, 229 and 258 | 85, 154, 229 and 289 | 85, 154, 229 and 303 | 85, 154, 229 and 336 | 85, 154, 258 and 289 |
| 85, 154, 258 and 303 | 85, 154, 258 and 336 | 85, 154, 289 and 303 | 85, 154, 289 and 336 | 85, 154, 303 and 336 |
| 85, 190, 225 and 229 | 85, 190, 225 and 258 | 85, 190, 225 and 289 | 85, 190, 225 and 303 | 85, 190, 225 and 336 |

TABLE 20-continued

| Non-limiting examples of positions that may comprise a mutation, or a set of mutations [as compared to SEQ ID NO: 35] | | | | |
|---|---|---|---|---|
| 85, 190, 229 and 258 | 85, 190, 229 and 289 | 85, 190, 229 and 303 | 85, 190, 229 and 336 | 85, 190, 258 and 289 |
| 85, 190, 258 and 303 | 85, 190, 258 and 336 | 85, 190, 289 and 303 | 85, 190, 289 and 336 | 85, 190, 303 and 336 |
| 85, 225, 229 and 258 | 85, 225, 229 and 289 | 85, 225, 229 and 303 | 85, 225, 229 and 336 | 85, 225, 258 and 289 |
| 85, 225, 258 and 303 | 85, 225, 258 and 336 | 85, 225, 289 and 303 | 85, 225, 289 and 336 | 85, 225, 303 and 336 |
| 85, 229, 258 and 289 | 85, 229, 258 and 303 | 85, 229, 258 and 336 | 85, 229, 289 and 303 | 85, 229, 289 and 336 |
| 85, 229, 303 and 336 | 85, 258, 289 and 303 | 85, 258, 289 and 336 | 85, 258, 303 and 336 | 85, 289, 303 and 336 |
| 121, 130, 134 and 154 | 121, 130, 134 and 190 | 121, 130, 134 and 225 | 121, 130, 134 and 229 | 121, 130, 134 and 258 |
| 121, 130, 134 and 289 | 121, 130, 134 and 303 | 121, 130, 134 and 336 | 121, 130, 154 and 190 | 121, 130, 154 and 225 |
| 121, 130, 154 and 229 | 121, 130, 154 and 258 | 121, 130, 154 and 289 | 121, 130, 154 and 303 | 121, 130, 154 and 336 |
| 121, 130, 190 and 225 | 121, 130, 190 and 229 | 121, 130, 190 and 258 | 121, 130, 190 and 289 | 121, 130, 190 and 303 |
| 121, 130, 190 and 336 | 121, 130, 225 and 229 | 121, 130, 225 and 258 | 121, 130, 225 and 289 | 121, 130, 225 and 303 |
| 121, 130, 225 and 336 | 121, 130, 229 and 258 | 121, 130, 229 and 289 | 121, 130, 229 and 303 | 121, 130, 229 and 336 |
| 121, 130, 258 and 289 | 121, 130, 258 and 303 | 121, 130, 258 and 336 | 121, 130, 289 and 303 | 121, 130, 289 and 336 |
| 121, 130, 303 and 336 | 121, 134, 154 and 190 | 121, 134, 154 and 225 | 121, 134, 154 and 229 | 121, 134, 154 and 258 |
| 121, 134, 154 and 289 | 121, 134, 154 and 303 | 121, 134, 154 and 336 | 121, 134, 190 and 225 | 121, 134, 190 and 229 |
| 121, 134, 190 and 258 | 121, 134, 190 and 289 | 121, 134, 190 and 303 | 121, 134, 190 and 336 | 121, 134, 225 and 229 |
| 121, 134, 225 and 258 | 121, 134, 225 and 289 | 121, 134, 225 and 303 | 121, 134, 225 and 336 | 121, 134, 229 and 258 |
| 121, 134, 229 and 289 | 121, 134, 229 and 303 | 121, 134, 229 and 336 | 121, 134, 258 and 289 | 121, 134, 258 and 303 |
| 121, 134, 258 and 336 | 121, 134, 289 and 303 | 121, 134, 289 and 336 | 121, 134, 303 and 336 | 121, 154, 190 and 225 |
| 121, 154, 190 and 229 | 121, 154, 190 and 289 | 121, 154, 190 and 303 | 121, 154, 190 and 303 | 121, 154, 190 and 336 |
| 121, 154, 225 and 229 | 121, 154, 225 and 258 | 121, 154, 225 and 289 | 121, 154, 225 and 303 | 121, 154, 225 and 336 |
| 121, 154, 229 and 258 | 121, 154, 229 and 289 | 121, 154, 229 and 303 | 121, 154, 229 and 336 | 121, 154, 258 and 289 |
| 121, 154, 258 and 303 | 121, 154, 258 and 336 | 121, 154, 289 and 303 | 121, 154, 289 and 336 | 121, 154, 303 and 336 |
| 121, 190, 225 and 229 | 121, 190, 225 and 258 | 121, 190, 225 and 289 | 121, 190, 225 and 303 | 121, 190, 225 and 336 |
| 121, 190, 229 and 258 | 121, 190, 229 and 289 | 121, 190, 229 and 303 | 121, 190, 229 and 336 | 121, 190, 258 and 289 |
| 121, 190, 258 and 303 | 121, 190, 258 and 336 | 121, 190, 289 and 303 | 121, 190, 289 and 336 | 121, 190, 303 and 336 |
| 121, 225, 229 and 258 | 121, 225, 229 and 289 | 121, 225, 229 and 303 | 121, 225, 229 and 336 | 121, 225, 258 and 289 |
| 121, 225, 258 and 303 | 121, 225, 258 and 336 | 121, 225, 289 and 303 | 121, 225, 289 and 336 | 121, 225, 303 and 336 |
| 121, 229, 258 and 289 | 121, 229, 258 and 303 | 121, 229, 258 and 336 | 121, 229, 289 and 303 | 121, 229, 289 and 336 |
| 121, 229, 303 and 336 | 121, 258, 289 and 303 | 121, 258, 289 and 336 | 121, 258, 303 and 336 | 121, 289, 303 and 336 |
| 130, 134, 154 and 190 | 130, 134, 154 and 225 | 130, 134, 154 and 229 | 130, 134, 154 and 258 | 130, 134, 154 and 289 |
| 130, 134, 154 and 303 | 130, 134, 154 and 336 | 130, 134, 190 and 225 | 130, 134, 190 and 229 | 130, 134, 190 and 258 |
| 130, 134, 190 and 289 | 130, 134, 190 and 303 | 130, 134, 190 and 336 | 130, 134, 225 and 229 | 130, 134, 225 and 258 |
| 130, 134, 225 and 289 | 130, 134, 225 and 303 | 130, 134, 225 and 336 | 130, 134, 229 and 258 | 130, 134, 229 and 289 |
| 130, 134, 229 and 303 | 130, 134, 229 and 336 | 130, 134, 258 and 289 | 130, 134, 258 and 303 | 130, 134, 258 and 336 |
| 130, 134, 289 and 303 | 130, 134, 289 and 336 | 130, 134, 303 and 336 | 130, 154, 190 and 225 | 130, 154, 190 and 229 |
| 130, 154, 190 and 258 | 130, 154, 190 and 289 | 130, 154, 190 and 303 | 130, 154, 190 and 336 | 130, 154, 225 and 229 |
| 130, 154, 225 and 258 | 130, 154, 225 and 289 | 130, 154, 225 and 303 | 130, 154, 225 and 336 | 130, 154, 229 and 258 |
| 130, 154, 229 and 289 | 130, 154, 229 and 303 | 130, 154, 229 and 336 | 130, 154, 258 and 289 | 130, 154, 258 and 303 |

TABLE 20-continued

| Non-limiting examples of positions that may comprise a mutation, or a set of mutations [as compared to SEQ ID NO: 35] | | | | |
|---|---|---|---|---|
| 130, 154, 258 and 336 | 130, 154, 289 and 336 | 130, 154, 289 and 336 | 130, 154, 303 and 336 | 130, 190, 225 and 229 |
| 130, 190, 225 and 258 | 130, 190, 225 and 289 | 130, 190, 225 and 303 | 130, 190, 225 and 336 | 130, 190, 229 and 258 |
| 130, 190, 229 and 289 | 130, 190, 229 and 303 | 130, 190, 229 and 336 | 130, 190, 258 and 289 | 130, 190, 258 and 303 |
| 130, 190, 258 and 336 | 130, 190, 289 and 303 | 130, 190, 289 and 336 | 130, 190, 303 and 336 | 130, 225, 229 and 258 |
| 130, 225, 229 and 289 | 130, 225, 229 and 303 | 130, 225, 229 and 336 | 130, 225, 258 and 289 | 130, 225, 258 and 303 |
| 130, 225, 258 and 336 | 130, 225, 289 and 303 | 130, 225, 289 and 336 | 130, 225, 303 and 336 | 130, 229, 258 and 289 |
| 130, 229, 258 and 303 | 130, 229, 258 and 336 | 130, 229, 289 and 303 | 130, 229, 289 and 336 | 130, 229, 303 and 336 |
| 130, 258, 289 and 303 | 130, 258, 289 and 336 | 130, 258, 303 and 336 | 130, 289, 303 and 336 | 134, 154, 190 and 225 |
| 134, 154, 190 and 229 | 134, 154, 190 and 258 | 134, 154, 190 and 289 | 134, 154, 190 and 303 | 134, 154, 190 and 336 |
| 134, 154, 225 and 229 | 134, 154, 225 and 258 | 134, 154, 225 and 289 | 134, 154, 225 and 303 | 134, 154, 225 and 336 |
| 134, 154, 229 and 258 | 134, 154, 229 and 289 | 134, 154, 229 and 303 | 134, 154, 229 and 336 | 134, 154, 258 and 289 |
| 134, 154, 258 and 303 | 134, 154, 258 and 336 | 134, 154, 289 and 303 | 134, 154, 289 and 336 | 134, 154, 303 and 336 |
| 134, 190, 225 and 229 | 134, 190, 225 and 258 | 134, 190, 225 and 289 | 134, 190, 225 and 303 | 134, 190, 225 and 336 |
| 134, 190, 229 and 258 | 134, 190, 229 and 289 | 134, 190, 229 and 303 | 134, 190, 229 and 336 | 134, 190, 258 and 289 |
| 134, 190, 258 and 303 | 134, 190, 258 and 336 | 134, 190, 289 and 303 | 134, 190, 289 and 336 | 134, 190, 303 and 336 |
| 134, 225, 229 and 258 | 134, 225, 229 and 289 | 134, 225, 229 and 303 | 134, 225, 229 and 336 | 134, 225, 258 and 289 |
| 134, 225, 258 and 303 | 134, 225, 258 and 336 | 134, 225, 289 and 303 | 134, 225, 289 and 336 | 134, 225, 303 and 336 |
| 134, 229, 258 and 289 | 134, 229, 258 and 303 | 134, 229, 258 and 336 | 134, 229, 289 and 303 | 134, 229, 289 and 336 |
| 134, 229, 303 and 336 | 134, 258, 289 and 303 | 134, 258, 289 and 336 | 134, 258, 303 and 336 | 134, 289, 303 and 336 |
| 154, 190, 225 and 229 | 154, 190, 225 and 258 | 154, 190, 225 and 289 | 154, 190, 225 and 303 | 154, 190, 225 and 336 |
| 154, 190, 229 and 258 | 154, 190, 229 and 289 | 154, 190, 229 and 303 | 154, 190, 229 and 336 | 154, 190, 258 and 289 |
| 154, 190, 258 and 303 | 154, 190, 258 and 336 | 154, 190, 289 and 303 | 154, 190, 289 and 336 | 154, 190, 303 and 336 |
| 154, 225, 229 and 258 | 154, 225, 229 and 289 | 154, 225, 229 and 303 | 154, 225, 229 and 336 | 154, 225, 258 and 289 |
| 154, 225, 258 and 303 | 154, 225, 258 and 336 | 154, 225, 289 and 303 | 154, 225, 289 and 336 | 154, 225, 303 and 336 |
| 154, 229, 258 and 289 | 154, 229, 258 and 303 | 154, 229, 258 and 336 | 154, 229, 289 and 303 | 154, 229, 289 and 336 |
| 154, 229, 303 and 336 | 154, 258, 289 and 303 | 154, 258, 289 and 336 | 154, 258, 303 and 336 | 154, 289, 303 and 336 |
| 190, 225, 229 and 258 | 190, 225, 229 and 289 | 190, 225, 229 and 303 | 190, 225, 229 and 336 | 190, 225, 258 and 289 |
| 190, 225, 258 and 303 | 190, 225, 258 and 336 | 190, 225, 289 and 303 | 190, 225, 289 and 336 | 190, 225, 303 and 336 |
| 190, 229, 258 and 289 | 190, 229, 258 and 303 | 190, 229, 258 and 336 | 190, 229, 289 and 303 | 190, 229, 289 and 336 |
| 190, 229, 303 and 336 | 190, 258, 289 and 303 | 190, 258, 289 and 336 | 190, 258, 303 and 336 | 190, 289, 303 and 336 |
| 225, 229, 258 and 289 | 225, 229, 258 and 303 | 225, 229, 258 and 336 | 225, 229, 289 and 303 | 225, 229, 289 and 336 |
| 225, 229, 303 and 336 | 225, 258, 289 and 303 | 225, 258, 289 and 336 | 225, 258, 303 and 336 | 225, 289, 303 and 336 |
| 229, 258, 289 and 303 | 229, 258, 289 and 336 | 229, 258, 303 and 336 | 229, 289, 303 and 336 | 258, 289, 303 and 336 |
| 60, 61, 63 and 64 | 60, 61, 63 and 74 | 60, 61, 63 and 76 | 60, 61, 63 and 146 | 60, 61, 63 and 227 |
| 60, 61, 63 and 229 | 60, 61, 64 and 74 | 60, 61, 64 and 76 | 60, 61, 64 and 146 | 60, 61, 64 and 227 |
| 60, 61, 64 and 229 | 60, 61, 74 and 76 | 60, 61, 74 and 146 | 60, 61, 74 and 227 | 60, 61, 74 and 229 |
| 60, 61, 76 and 146 | 60, 61, 76 and 227 | 60, 61, 76 and 229 | 60, 61, 146 and 227 | 60, 61, 146 and 229 |
| 60, 61, 227 and 229 | 60, 63, 64 and 74 | 60, 63, 64 and 76 | 60, 63, 64 and 146 | 60, 63, 64 and 227 |
| 60, 63, 64 and 229 | 60, 63, 74 and 76 | 60, 63, 74 and 146 | 60, 63, 74 and 227 | 60, 63, 74 and 229 |

TABLE 20-continued

Non-limiting examples of positions that may comprise a mutation, or a set of mutations [as compared to SEQ ID NO: 35]

| | | | | |
|---|---|---|---|---|
| 60, 63, 76 and 146 | 60, 63, 76 and 227 | 60, 63, 76 and 229 | 60, 63, 146 and 227 | 60, 63, 146 and 229 |
| 60, 63, 227 and 229 | 60, 64, 74 and 76 | 60, 64, 74 and 146 | 60, 64, 74 and 227 | 60, 64, 74 and 229 |
| 60, 64, 76 and 146 | 60, 64, 76 and 227 | 60, 64, 76 and 229 | 60, 64, 146 and 227 | 60, 64, 146 and 229 |
| 60, 64, 227 and 229 | 60, 74, 76 and 146 | 60, 74, 76 and 227 | 60, 74, 76 and 229 | 60, 74, 146 and 227 |
| 60, 74, 146 and 229 | 60, 74, 227 and 229 | 60, 76, 146 and 227 | 60, 76, 146 and 229 | 60, 76, 227 and 229 |
| 60, 146, 227 and 229 | 61, 63, 64 and 74 | 61, 63, 64 and 76 | 61, 63, 64 and 146 | 61, 63, 64 and 227 |
| 61, 63, 64 and 229 | 61, 63, 74 and 76 | 61, 63, 74 and 146 | 61, 63, 74 and 227 | 61, 63, 74 and 229 |
| 61, 63, 76 and 146 | 61, 63, 76 and 227 | 61, 63, 76 and 229 | 61, 63, 146 and 227 | 61, 63, 146 and 229 |
| 61, 63, 227 and 229 | 61, 64, 74 and 76 | 61, 64, 74 and 146 | 61, 64, 74 and 227 | 61, 64, 74 and 229 |
| 61, 64, 76 and 146 | 61, 64, 76 and 227 | 61, 64, 76 and 229 | 61, 64, 146 and 227 | 61, 64, 146 and 229 |
| 61, 64, 227 and 229 | 61, 74, 76 and 146 | 61, 74, 76 and 227 | 61, 74, 76 and 229 | 61, 74, 146 and 227 |
| 61, 74, 146 and 229 | 61, 74, 227 and 229 | 61, 76, 146 and 227 | 61, 76, 146 and 229 | 61, 76, 227 and 229 |
| 61, 146, 227 and 229 | 63, 64, 74 and 76 | 63, 64, 74 and 146 | 63, 64, 74 and 227 | 63, 64, 74 and 229 |
| 63, 64, 76 and 146 | 63, 64, 76 and 227 | 63, 64, 76 and 229 | 63, 64, 146 and 227 | 63, 64, 146 and 229 |
| 63, 64, 227 and 229 | 63, 74, 76 and 146 | 63, 74, 76 and 227 | 63, 74, 76 and 229 | 63, 74, 146 and 227 |
| 63, 74, 146 and 229 | 63, 74, 227 and 229 | 63, 76, 146 and 227 | 63, 76, 146 and 229 | 63, 76, 227 and 229 |
| 63, 146, 227 and 229 | 64, 74, 76 and 146 | 64, 74, 76 and 227 | 64, 74, 76 and 229 | 64, 74, 146 and 227 |
| 64, 74, 146 and 229 | 64, 74, 227 and 229 | 64, 76, 146 and 227 | 64, 76, 146 and 229 | 64, 76, 227 and 229 |
| 64, 146, 227 and 229 | 74, 76, 146 and 227 | 74, 76, 146 and 229 | 74, 76, 227 and 229 | 74, 146, 227 and 229 |
| 76, 146, 227 and 229 | 60, 61, 63, 64 and 74 | 60, 61, 63, 64 and 76 | 60, 61, 63, 64 and 146 | 60, 61, 63, 64 and 227 |
| 60, 61, 63, 64 and 229 | 60, 61, 63, 74 and 76 | 60, 61, 63, 74 and 146 | 60, 61, 63, 74 and 227 | 60, 61, 63, 74 and 229 |
| 60, 61, 63, 76 and 146 | 60, 61, 63, 76 and 227 | 60, 61, 63, 76 and 229 | 60, 61, 63, 146 and 227 | 60, 61, 63, 146 and 229 |
| 60, 61, 63, 227 and 229 | 60, 61, 64, 74 and 76 | 60, 61, 64, 74 and 146 | 60, 61, 64, 74 and 227 | 60, 61, 64, 74 and 229 |
| 60, 61, 64, 76 and 146 | 60, 61, 64, 76 and 227 | 60, 61, 64, 76 and 229 | 60, 61, 64, 146 and 227 | 60, 61, 64, 146 and 229 |
| 60, 61, 64, 227 and 229 | 60, 61, 74, 76 and 146 | 60, 61, 74, 76 and 227 | 60, 61, 74, 76 and 229 | 60, 61, 74, 146 and 227 |
| 60, 61, 74, 146 and 229 | 60, 61, 74, 227 and 229 | 60, 61, 76, 146 and 227 | 60, 61, 76, 146 and 229 | 60, 61, 76, 227 and 229 |
| 60, 61, 146, 227 and 229 | 60, 63, 64, 74 and 76 | 60, 63, 64, 74 and 146 | 60, 63, 64, 74 and 227 | 60, 63, 64, 74 and 229 |
| 60, 63, 64, 76 and 146 | 60, 63, 64, 76 and 227 | 60, 63, 64, 76 and 229 | 60, 63, 64, 146 and 227 | 60, 63, 64, 146 and 229 |
| 60, 63, 64, 227 and 229 | 60, 63, 74, 76 and 146 | 60, 63, 74, 76 and 227 | 60, 63, 74, 76 and 229 | 60, 63, 74, 146 and 227 |
| 60, 63, 74, 146 and 229 | 60, 63, 74, 227 and 229 | 60, 63, 76, 146 and 227 | 60, 63, 76, 146 and 229 | 60, 63, 76, 227 and 229 |
| 60, 63, 146, 227 and 229 | 60, 64, 74, 76 and 146 | 60, 64, 74, 76 and 227 | 60, 64, 74, 76 and 229 | 60, 64, 74, 146 and 227 |
| 60, 64, 74, 146 and 229 | 60, 64, 74, 227 and 229 | 60, 64, 76, 146 and 227 | 60, 64, 76, 146 and 229 | 60, 64, 76, 227 and 229 |
| 60, 64, 146, 227 and 229 | 60, 74, 76, 146 and 227 | 60, 74, 76, 146 and 229 | 60, 74, 76, 227 and 229 | 60, 74, 146, 227 and 229 |
| 60, 76, 146, 227 and 229 | 61, 63, 64, 74 and 76 | 61, 63, 64, 74 and 146 | 61, 63, 64, 74 and 227 | 61, 63, 64, 74 and 229 |
| 61, 63, 64, 76 and 146 | 61, 63, 64, 76 and 227 | 61, 63, 64, 76 and 229 | 61, 63, 64, 146 and 227 | 61, 63, 64, 146 and 229 |
| 61, 63, 64, 227 and 229 | 61, 63, 74, 76 and 146 | 61, 63, 74, 76 and 227 | 61, 63, 74, 76 and 229 | 61, 63, 74, 146 and 227 |
| 61, 63, 74, 146 and 229 | 61, 63, 74, 227 and 229 | 61, 63, 76, 146 and 227 | 61, 63, 76, 146 and 229 | 61, 63, 76, 227 and 229 |
| 61, 63, 146, 227 and 229 | 61, 64, 74, 76 and 146 | 61, 64, 74, 76 and 227 | 61, 64, 74, 76 and 229 | 61, 64, 74, 146 and 227 |
| 61, 64, 74, 146 and 229 | 61, 64, 74, 227 and 229 | 61, 64, 76, 146 and 227 | 61, 64, 76, 146 and 229 | 61, 64, 76, 227 and 229 |

TABLE 20-continued

| Non-limiting examples of positions that may comprise a mutation, or a set of mutations [as compared to SEQ ID NO: 35] | | | | |
|---|---|---|---|---|
| 61, 64, 146, 227 and 229 | 61, 74, 76, 146 and 229 | 61, 74, 76, 146 and 229 | 61, 74, 76, 227 and 229 | 61, 74, 146, 227 and 229 |
| 61, 76, 146, 227 and 229 | 63, 64, 74, 76 and 146 | 63, 64, 74, 76 and 227 | 63, 64, 74, 76 and 229 | 63, 64, 74, 146 and 227 |
| 63, 64, 74, 146 and 229 | 63, 64, 74, 227 and 229 | 63, 64, 76, 146 and 227 | 63, 64, 76, 146 and 229 | 63, 64, 76, 227 and 229 |
| 63, 64, 146, 227 and 229 | 63, 74, 76, 146 and 227 | 63, 74, 76, 146 and 229 | 63, 74, 76, 227 and 229 | 63, 74, 146, 227 and 229 |
| 63, 76, 146, 227 and 229 | 64, 74, 76, 146 and 227 | 64, 74, 76, 146 and 229 | 64, 74, 76, 227 and 229 | 64, 74, 146, 227 and 229 |
| 64, 76, 146, 227 and 229 | 74, 76, 146, 227 and 229 | 60, 61, 63, 64, 74 and 76 | 60, 61, 63, 64, 74 and 146 | 60, 61, 63, 64, 74 and 227 |
| 60, 61, 63, 64, 74 and 229 | 60, 61, 63, 64, 76 and 146 | 60, 61, 63, 64, 76 and 227 | 60, 61, 63, 64, 76 and 229 | 60, 61, 63, 64, 146 and 227 |
| 60, 61, 63, 64, 146 and 229 | 60, 61, 63, 64, 227 and 229 | 60, 61, 63, 74, 76 and 146 | 60, 61, 63, 74, 76 and 227 | 60, 61, 63, 74, 76 and 229 |
| 60, 61, 63, 74, 146 and 227 | 60, 61, 63, 74, 146 and 229 | 60, 61, 63, 74, 227 and 229 | 60, 61, 63, 76, 146 and 227 | 60, 61, 63, 76, 146 and 229 |
| 60, 61, 63, 76, 227 and 229 | 60, 61, 63, 146, 227 and 229 | 60, 61, 64, 74, 76 and 146 | 60, 61, 64, 74, 76 and 227 | 60, 61, 64, 74, 76 and 229 |
| 60, 61, 64, 74, 146 and 227 | 60, 61, 64, 74, 146 and 229 | 60, 61, 64, 74, 227 and 229 | 60, 61, 64, 76, 146 and 227 | 60, 61, 64, 76, 146 and 229 |
| 60, 61, 64, 76, 227 and 229 | 60, 61, 64, 146, 227 and 229 | 60, 61, 74, 76, 146 and 227 | 60, 61, 74, 76, 146 and 229 | 60, 61, 74, 76, 227 and 229 |
| 60, 61, 74, 146, 227 and 229 | 60, 61, 76, 146, 227 and 229 | 60, 63, 64, 74, 76 and 146 | 60, 63, 64, 74, 76 and 227 | 60, 63, 64, 74, 76 and 229 |
| 60, 63, 64, 74, 146 and 227 | 60, 63, 64, 74, 146 and 229 | 60, 63, 64, 74, 227 and 229 | 60, 63, 64, 76, 146 and 227 | 60, 63, 64, 76, 146 and 229 |
| 60, 63, 64, 76, 227 and 229 | 60, 63, 64, 146, 227 and 229 | 60, 63, 74, 76, 146 and 227 | 60, 63, 74, 76, 146 and 229 | 60, 63, 74, 76, 227 and 229 |
| 60, 63, 74, 146, 227 and 229 | 60, 63, 76, 146, 227 and 229 | 60, 64, 74, 76, 146 and 227 | 60, 64, 74, 76, 146 and 229 | 60, 64, 74, 76, 227 and 229 |
| 60, 64, 74, 146, 227 and 229 | 60, 64, 76, 146, 227 and 229 | 60, 74, 76, 146, 227 and 229 | 61, 63, 64, 74, 76 and 146 | 61, 63, 64, 74, 76 and 227 |
| 61, 63, 64, 74, 76 and 229 | 61, 63, 64, 74, 146 and 227 | 61, 63, 64, 74, 146 and 229 | 61, 63, 64, 74, 227 and 229 | 61, 63, 64, 76, 146 and 227 |
| 61, 63, 64, 76, 146 and 229 | 61, 63, 64, 76, 227 and 229 | 61, 63, 64, 146, 227 and 229 | 61, 63, 74, 76, 146 and 227 | 61, 63, 74, 76, 146 and 229 |
| 61, 63, 74, 76, 227 and229 | 61, 63, 74, 146, 227 and229 | 61, 63, 76, 146, 227 and 229 | 61, 64, 74, 76, 146 and 227 | 61, 64, 74, 76, 146 and 229 |
| 61, 64, 74, 76, 227 and 229 | 61, 64, 74, 146, 227 and229 | 61, 64, 76, 146, 227 and 229 | 61, 74, 76, 146, 227 and 229 | 63, 64, 74, 76, 146 and 227 |
| 63, 64, 74, 76, 146 and 229 | 63, 64, 74, 76, 227 and 229 | 63, 64, 74, 146, 227 and 229 | 63, 64, 76, 146, 227 and 229 | 63, 74, 76, 146, 227 and 229 |
| 64, 74, 76, 146, 227 and 229 | 60, 61, 63, 64, 74, 76 and 146 | 60, 61, 63, 64, 74, 76 and 227 | 60, 61, 63, 64, 74, 76 and 229 | 60, 61, 63, 64, 74, 146 and 227 |
| 60, 61, 63, 64, 74, 146 and 229 | 60, 61, 63, 64, 74, 227 and 229 | 60, 61, 63, 64, 76, 146 and 227 | 60, 61, 63, 64, 76, 146 and 229 | 60, 61, 63, 64, 76, 227 and 229 |
| 60, 61, 63, 64, 146, 227 and 229 | 60, 61, 63, 74, 76, 146 and 227 | 60, 61, 63, 74, 76, 146 and 229 | 60, 61, 63, 74, 76, 227 and 229 | 60, 61, 63, 74, 146, 227 and 229 |
| 60, 61, 63, 76, 146, 227 and 229 | 60, 61, 64, 74, 76, 146 and 227 | 60, 61, 64, 74, 76, 146 and 229 | 60, 61, 64, 74, 76, 227 and 229 | 60, 61, 64, 74, 146, 227 and 229 |
| 60, 61, 64, 76, 146, 227 and 229 | 60, 61, 74, 76, 146, 227 and 229 | 60, 63, 64, 74, 76, 146 and 227 | 60, 63, 64, 74, 76, 146 and 229 | 60, 63, 64, 74, 76, 227 and 229 |
| 60, 63, 64, 74, 146, 227 and 229 | 60, 63, 64, 76, 146, 227 and 229 | 60, 63, 74, 76, 146, 227 and 229 | 60, 64, 74, 76, 146, 227 and 229 | 61, 63, 64, 74, 76, 146 and 227 |
| 61, 63, 64, 74, 76, 146 and 229 | 61, 63, 64, 74, 76, 227 and 229 | 61, 63, 64, 74, 146, 227 and 229 | 61, 63, 64, 76, 146, 227 and 229 | 61, 63, 74, 76, 146, 227 and 229 |
| 61, 64, 74, 76, 146, 227 and 229 | 63, 64, 74, 76, 146, 227 and 229 | 60, 61, 63, 64, 74, 76, 146 and 227 | 60, 61, 63, 64, 74, 76, 146 and 229 | 60, 61, 63, 64, 74, 76, 227 and 229 |
| 60, 61, 63, 64, 74, 146, 227 and 229 | 60, 61, 63, 64, 76, 146, 227 and 229 | 60, 61, 63, 74, 76, 146, 227 and 229 | 60, 61, 64, 74, 76, 146, 227 and 229 | 60, 63, 64, 74, 76, 146, 227 and 229 |
| 61, 63, 64, 74, 76, 146, 227 and 229 | 60, 61, 63, 64, 74, 76, 146, 227 and 229 | 85, 121 and 130 | | |
| 85, 121, 130, 134 and 154 | 85, 121, 130, 134 and 190 | 85, 121, 130, 134 and 225 | 85, 121, 130, 134 and 229 | 85, 121, 130, 134 and 258 |
| 85, 121, 130, 134 and 289 | 85, 121, 130, 134 and 303 | 85, 121, 130, 134 and 336 | 85, 121, 130, 154 and 190 | 85, 121, 130, 154 and 225 |
| 85, 121, 130, 154 and 229 | 85, 121, 130, 154 and 258 | 85, 121, 130, 154 and 289 | 85, 121, 130, 154 and 303 | 85, 121, 130, 154 and 336 |
| 85, 121, 130, 190 and 225 | 85, 121, 130, 190 and 229 | 85, 121, 130, 190 and 258 | 85, 121, 130, 190 and 289 | 85, 121, 130, 190 and 303 |
| 85, 121, 130, 190 and 336 | 85, 121, 130, 225 and 229 | 85, 121, 130, 225 and 258 | 85, 121, 130, 225 and 289 | 85, 121, 130, 225 and 303 |
| 85, 121, 130, 225 and 336 | 85, 121, 130, 229 and 258 | 85, 121, 130, 229 and 289 | 85, 121, 130, 229 and 303 | 85, 121, 130, 229 and 336 |
| 85, 121, 130, 258 and 289 | 85, 121, 130, 258 and 303 | 85, 121, 130, 258 and 336 | 85, 121, 130, 289 and 303 | 85, 121, 130, 289 and 336 |

TABLE 20-continued

| Non-limiting examples of positions that may comprise a mutation, or a set of mutations [as compared to SEQ ID NO: 35] | | | | |
|---|---|---|---|---|
| 85, 121, 130, 303 and 336 | 85, 121, 134, 154 and 190 | 85, 121, 134, 154 and 225 | 85, 121, 134, 154 and 229 | 85, 121, 134, 154 and 258 |
| 85, 121, 134, 154 and 289 | 85, 121, 134, 154 and 303 | 85, 121, 134, 154 and 336 | 85, 121, 134, 190 and 225 | 85, 121, 134, 190 and 229 |
| 85, 121, 134, 190 and 258 | 85, 121, 134, 190 and 289 | 85, 121, 134, 190 and 303 | 85, 121, 134, 190 and 336 | 85, 121, 134, 225 and 229 |
| 85, 121, 134, 225 and 258 | 85, 121, 134, 225 and 289 | 85, 121, 134, 225 and 303 | 85, 121, 134, 225 and 336 | 85, 121, 134, 229 and 258 |
| 85, 121, 134, 229 and 289 | 85, 121, 134, 229 and 303 | 85, 121, 134, 229 and 336 | 85, 121, 134, 258 and 289 | 85, 121, 134, 258 and 303 |
| 85, 121, 134, 258 and 336 | 85, 121, 134, 289 and 303 | 85, 121, 134, 289 and 336 | 85, 121, 134, 303 and 336 | 85, 121, 154, 190 and 225 |
| 85, 121, 154, 190 and 229 | 85, 121, 154, 190 and 258 | 85, 121, 154, 190 and 289 | 85, 121, 154, 190 and 303 | 85, 121, 154, 190 and 336 |
| 85, 121, 154, 225 and 229 | 85, 121, 154, 225 and 258 | 85, 121, 154, 225 and 289 | 85, 121, 154, 225 and 303 | 85, 121, 154, 225 and 336 |
| 85, 121, 154, 229 and 258 | 85, 121, 154, 229 and 289 | 85, 121, 154, 229 and 303 | 85, 121, 154, 229 and 336 | 85, 121, 154, 258 and 289 |
| 85, 121, 154, 258 and 303 | 85, 121, 154, 258 and 336 | 85, 121, 154, 289 and 303 | 85, 121, 154, 289 and 336 | 85, 121, 154, 303 and 336 |
| 85, 121, 190, 225 and 229 | 85, 121, 190, 225 and 258 | 85, 121, 190, 225 and 289 | 85, 121, 190, 225 and 303 | 85, 121, 190, 225 and 336 |
| 85, 121, 190, 229 and 258 | 85, 121, 190, 229 and 289 | 85, 121, 190, 229 and 303 | 85, 121, 190, 229 and 336 | 85, 121, 190, 258 and 289 |
| 85, 121, 190, 258 and 303 | 85, 121, 190, 258 and 336 | 85, 121, 190, 289 and 303 | 85, 121, 190, 289 and 336 | 85, 121, 190, 303 and 336 |
| 85, 121, 225, 229 and 258 | 85, 121, 225, 229 and 289 | 85, 121, 225, 229 and 303 | 85, 121, 225, 229 and 336 | 85, 121, 225, 258 and 289 |
| 85, 121, 225, 258 and 303 | 85, 121, 225, 258 and 336 | 85, 121, 225, 289 and 303 | 85, 121, 225, 289 and 336 | 85, 121, 225, 303 and 336 |
| 85, 121, 229, 258 and 289 | 85, 121, 229, 258 and 303 | 85, 121, 229, 258 and 336 | 85, 121, 229, 289 and 303 | 85, 121, 229, 289 and 336 |
| 85, 121, 229, 303 and 336 | 85, 121, 258, 289 and 303 | 85, 121, 258, 289 and 336 | 85, 121, 258, 303 and 336 | 85, 121, 289, 303 and 336 |
| 85, 130, 134, 154 and 190 | 85, 130, 134, 154 and 225 | 85, 130, 134, 154 and 229 | 85, 130, 134, 154 and 258 | 85, 130, 134, 154 and 289 |
| 85, 130, 134, 154 and 303 | 85, 130, 134, 154 and 336 | 85, 130, 134, 190 and 225 | 85, 130, 134, 190 and 229 | 85, 130, 134, 190 and 258 |
| 85, 130, 134, 190 and 289 | 85, 130, 134, 190 and 303 | 85, 130, 134, 190 and 336 | 85, 130, 134, 225 and 229 | 85, 130, 134, 225 and 258 |
| 85, 130, 134, 225 and 289 | 85, 130, 134, 225 and 303 | 85, 130, 134, 225 and 336 | 85, 130, 134, 229 and 258 | 85, 130, 134, 229 and 289 |
| 85, 130, 134, 229 and 303 | 85, 130, 134, 229 and 336 | 85, 130, 134, 258 and 289 | 85, 130, 134, 258 and 303 | 85, 130, 134, 258 and 336 |
| 85, 130, 134, 289 and 303 | 85, 130, 134, 289 and 336 | 85, 130, 134, 303 and 336 | 85, 130, 154, 190 and 225 | 85, 130, 154, 190 and 229 |
| 85, 130, 154, 190 and 258 | 85, 130, 154, 190 and 289 | 85, 130, 154, 190 and 303 | 85, 130, 154, 190 and 336 | 85, 130, 154, 225 and 229 |
| 85, 130, 154, 225 and 258 | 85, 130, 154, 225 and 289 | 85, 130, 154, 225 and 303 | 85, 130, 154, 225 and 336 | 85, 130, 154, 229 and 258 |
| 85, 130, 154, 229 and 289 | 85, 130, 154, 229 and 303 | 85, 130, 154, 229 and 336 | 85, 130, 154, 258 and 289 | 85, 130, 154, 258 and 303 |
| 85, 130, 154, 258 and 336 | 85, 130, 154, 289 and 303 | 85, 130, 154, 289 and 336 | 85, 130, 154, 303 and 336 | 85, 130, 190, 225 and 229 |
| 85, 130, 190, 225 and 258 | 85, 130, 190, 225 and 289 | 85, 130, 190, 225 and 303 | 85, 130, 190, 225 and 336 | 85, 130, 190, 229 and 258 |
| 85, 130, 190, 229 and 289 | 85, 130, 190, 229 and 303 | 85, 130, 190, 229 and 336 | 85, 130, 190, 258 and 289 | 85, 130, 190, 258 and 303 |
| 85, 130, 190, 258 and 336 | 85, 130, 190, 289 and 303 | 85, 130, 190, 289 and 336 | 85, 130, 190, 303 and 336 | 85, 130, 225, 229 and 258 |
| 85, 130, 225, 229 and 289 | 85, 130, 225, 229 and 303 | 85, 130, 225, 229 and 336 | 85, 130, 225, 258 and 289 | 85, 130, 225, 258 and 303 |
| 85, 130, 225, 258 and 336 | 85, 130, 225, 289 and 303 | 85, 130, 225, 289 and 336 | 85, 130, 225, 303 and 336 | 85, 130, 229, 258 and 289 |
| 85, 130, 229, 258 and 303 | 85, 130, 229, 258 and 336 | 85, 130, 229, 289 and 303 | 85, 130, 229, 289 and 336 | 85, 130, 229, 303 and 336 |
| 85, 130, 258, 289 and 303 | 85, 130, 258, 289 and 336 | 85, 130, 258, 303 and 336 | 85, 130, 289, 303 and 336 | 85, 134, 154, 190 and 225 |
| 85, 134, 154, 190 and 229 | 85, 134, 154, 190 and 258 | 85, 134, 154, 190 and 289 | 85, 134, 154, 190 and 303 | 85, 134, 154, 190 and 336 |
| 85, 134, 154, 225 and 229 | 85, 134, 154, 225 and 258 | 85, 134, 154, 225 and 289 | 85, 134, 154, 225 and 303 | 85, 134, 154, 225 and 336 |
| 85, 134, 154, 229 and 258 | 85, 134, 154, 229 and 289 | 85, 134, 154, 229 and 303 | 85, 134, 154, 229 and 336 | 85, 134, 154, 258 and 289 |
| 85, 134, 154, 258 and 303 | 85, 134, 154, 258 and 336 | 85, 134, 154, 289 and 303 | 85, 134, 154, 289 and 336 | 85, 134, 154, 303 and 336 |
| 85, 134, 190, 225 and 229 | 85, 134, 190, 225 and 258 | 85, 134, 190, 225 and 289 | 85, 134, 190, 225 and 303 | 85, 134, 190, 225 and 336 |

TABLE 20-continued

Non-limiting examples of positions that may comprise a mutation, or a set of mutations [as compared to SEQ ID NO: 35]

| | | | | |
|---|---|---|---|---|
| 85, 134, 190, 229 and 258 | 85, 134, 190, 229 and 289 | 85, 134, 190, 229 and 303 | 85, 134, 190, 229 and 336 | 85, 134, 190, 258 and 289 |
| 85, 134, 190, 258 and 303 | 85, 134, 190, 258 and 336 | 85, 134, 190, 289 and 303 | 85, 134, 190, 289 and 336 | 85, 134, 190, 303 and 336 |
| 85, 134, 225, 229 and 258 | 85, 134, 225, 229 and 289 | 85, 134, 225, 229 and 303 | 85, 134, 225, 229 and 336 | 85, 134, 225, 258 and 289 |
| 85, 134, 225, 258 and 303 | 85, 134, 225, 258 and 336 | 85, 134, 225, 289 and 303 | 85, 134, 225, 289 and 336 | 85, 134, 225, 303 and 336 |
| 85, 134, 229, 258 and 289 | 85, 134, 229, 258 and 303 | 85, 134, 229, 258 and 336 | 85, 134, 229, 289 and 303 | 85, 134, 229, 289 and 336 |
| 85, 134, 229, 303 and 336 | 85, 134, 258, 289 and 303 | 85, 134, 258, 289 and 336 | 85, 134, 258, 303 and 336 | 85, 134, 289, 303 and 336 |
| 85, 154, 190, 225 and 229 | 85, 154, 190, 225 and 258 | 85, 154, 190, 225 and 289 | 85, 154, 190, 225 and 303 | 85, 154, 190, 225 and 336 |
| 85, 154, 190, 229 and 258 | 85, 154, 190, 229 and 289 | 85, 154, 190, 229 and 303 | 85, 154, 190, 229 and 336 | 85, 154, 190, 258 and 289 |
| 85, 154, 190, 258 and 303 | 85, 154, 190, 258 and 336 | 85, 154, 190, 289 and 303 | 85, 154, 190, 289 and 336 | 85, 154, 190, 303 and 336 |
| 85, 154, 225, 229 and 258 | 85, 154, 225, 229 and 289 | 85, 154, 225, 229 and 303 | 85, 154, 225, 229 and 336 | 85, 154, 225, 258 and 289 |
| 85, 154, 225, 258 and 303 | 85, 154, 225, 258 and 336 | 85, 154, 225, 289 and 303 | 85, 154, 225, 289 and 336 | 85, 154, 225, 303 and 336 |
| 85, 154, 229, 258 and 289 | 85, 154, 229, 258 and 303 | 85, 154, 229, 258 and 336 | 85, 154, 229, 289 and 303 | 85, 154, 229, 289 and 336 |
| 85, 154, 229, 303 and 336 | 85, 154, 258, 289 and 303 | 85, 154, 258, 289 and 336 | 85, 154, 258, 303 and 336 | 85, 154, 289, 303 and 336 |
| 85, 190, 225, 229 and 258 | 85, 190, 225, 229 and 289 | 85, 190, 225, 229 and 303 | 85, 190, 225, 229 and 336 | 85, 190, 225, 258 and 289 |
| 85, 190, 225, 258 and 303 | 85, 190, 225, 258 and 336 | 85, 190, 225, 289 and 303 | 85, 190, 225, 289 and 336 | 85, 190, 225, 303 and 336 |
| 85, 190, 229, 258 and 289 | 85, 190, 229, 258 and 303 | 85, 190, 229, 258 and 336 | 85, 190, 229, 289 and 303 | 85, 190, 229, 289 and 336 |
| 85, 190, 229, 303 and 336 | 85, 190, 258, 289 and 303 | 85, 190, 258, 289 and 336 | 85, 190, 258, 303 and 336 | 85, 190, 289, 303 and 336 |
| 85, 225, 229, 258 and 289 | 85, 225, 229, 258 and 303 | 85, 225, 229, 258 and 336 | 85, 225, 229, 289 and 303 | 85, 225, 229, 289 and 336 |
| 85, 225, 229, 303 and 336 | 85, 225, 258, 289 and 303 | 85, 225, 258, 289 and 336 | 85, 225, 258, 303 and 336 | 85, 225, 289, 303 and 336 |
| 85, 229, 258, 289 and 303 | 85, 229, 258, 289 and 336 | 85, 229, 258, 303 and 336 | 85, 229, 289, 303 and 336 | 85, 258, 289, 303 and 336 |
| 121, 130, 134, 154 and 190 | 121, 130, 134, 154 and 225 | 121, 130, 134, 154 and 229 | 121, 130, 134, 154 and 258 | 121, 130, 134, 154 and 289 |
| 121, 130, 134, 154 and 303 | 121, 130, 134, 154 and 336 | 121, 130, 134, 190 and 225 | 121, 130, 134, 190 and 229 | 121, 130, 134, 190 and 258 |
| 121, 130, 134, 190 and 289 | 121, 130, 134, 190 and 303 | 121, 130, 134, 190 and 336 | 121, 130, 134, 225 and 229 | 121, 130, 134, 225 and 258 |
| 121, 130, 134, 225 and 289 | 121, 130, 134, 225 and 303 | 121, 130, 134, 225 and 336 | 121, 130, 134, 229 and 258 | 121, 130, 134, 229 and 289 |
| 121, 130, 134, 229 and 303 | 121, 130, 134, 229 and 336 | 121, 130, 134, 258 and 289 | 121, 130, 134, 258 and 303 | 121, 130, 134, 258 and 336 |
| 121, 130, 134, 289 and 303 | 121, 130, 134, 289 and 336 | 121, 130, 134, 303 and 336 | 121, 130, 154, 190 and 225 | 121, 130, 154, 190 and 229 |
| 121, 130, 154, 190 and 258 | 121, 130, 154, 190 and 289 | 121, 130, 154, 190 and 303 | 121, 130, 154, 190 and 336 | 121, 130, 154, 225 and 229 |
| 121, 130, 154, 225 and 258 | 121, 130, 154, 225 and 289 | 121, 130, 154, 225 and 303 | 121, 130, 154, 225 and 336 | 121, 130, 154, 229 and 258 |
| 121, 130, 154, 229 and 289 | 121, 130, 154, 229 and 303 | 121, 130, 154, 229 and 336 | 121, 130, 154, 258 and 289 | 121, 130, 154, 258 and 303 |
| 121, 130, 154, 258 and 336 | 121, 130, 154, 289 and 303 | 121, 130, 154, 289 and 336 | 121, 130, 154, 303 and 336 | 121, 130, 190, 225 and 229 |
| 121, 130, 190, 225 and 258 | 121, 130, 190, 225 and 289 | 121, 130, 190, 225 and 303 | 121, 130, 190, 225 and 336 | 121, 130, 190, 229 and 258 |
| 121, 130, 190, 229 and 289 | 121, 130, 190, 229 and 303 | 121, 130, 190, 229 and 336 | 121, 130, 190, 258 and 289 | 121, 130, 190, 258 and 303 |
| 121, 130, 190, 258 and 336 | 121, 130, 190, 289 and 303 | 121, 130, 190, 289 and 336 | 121, 130, 190, 303 and 336 | 121, 130, 225, 229 and 258 |
| 121, 130, 225, 229 and 289 | 121, 130, 225, 229 and 303 | 121, 130, 225, 229 and 336 | 121, 130, 225, 258 and 289 | 121, 130, 225, 258 and 303 |
| 121, 130, 225, 258 and 336 | 121, 130, 225, 289 and 303 | 121, 130, 225, 289 and 336 | 121, 130, 225, 303 and 336 | 121, 130, 229, 258 and 289 |
| 121, 130, 229, 258 and 303 | 121, 130, 229, 258 and 336 | 121, 130, 229, 289 and 303 | 121, 130, 229, 289 and 336 | 121, 130, 229, 303 and 336 |
| 121, 130, 258, 289 and 303 | 121, 130, 258, 289 and 336 | 121, 130, 258, 303 and 336 | 121, 130, 289, 303 and 336 | 121, 134, 154, 190 and 225 |
| 121, 134, 154, 190 and 229 | 121, 134, 154, 190 and 258 | 121, 134, 154, 190 and 289 | 121, 134, 154, 190 and 303 | 121, 134, 154, 190 and 336 |
| 121, 134, 154, 225 and 229 | 121, 134, 154, 225 and 258 | 121, 134, 154, 225 and 289 | 121, 134, 154, 225 and 303 | 121, 134, 154, 225 and 336 |

TABLE 20-continued

| Non-limiting examples of positions that may comprise a mutation, or a set of mutations [as compared to SEQ ID NO: 35] | | | | |
|---|---|---|---|---|
| 121, 134, 154, 229 and 258 | 121, 134, 154, 229 and 289 | 121, 134, 154, 229 and 303 | 121, 134, 154, 229 and 336 | 121, 134, 154, 258 and 289 |
| 121, 134, 154, 258 and 303 | 121, 134, 154, 258 and 336 | 121, 134, 154, 289 and 303 | 121, 134, 154, 289 and 336 | 121, 134, 154, 303 and 336 |
| 121, 134, 190, 225 and 229 | 121, 134, 190, 225 and 258 | 121, 134, 190, 225 and 289 | 121, 134, 190, 225 and 303 | 121, 134, 190, 225 and 336 |
| 121, 134, 190, 229 and 258 | 121, 134, 190, 229 and 289 | 121, 134, 190, 229 and 303 | 121, 134, 190, 229 and 336 | 121, 134, 190, 258 and 289 |
| 121, 134, 190, 258 and 303 | 121, 134, 190, 258 and 336 | 121, 134, 190, 289 and 303 | 121, 134, 190, 289 and 336 | 121, 134, 190, 303 and 336 |
| 121, 134, 225, 229 and 258 | 121, 134, 225, 229 and 289 | 121, 134, 225, 229 and 303 | 121, 134, 225, 229 and 336 | 121, 134, 225, 258 and 289 |
| 121, 134, 225, 258 and 303 | 121, 134, 225, 258 and 336 | 121, 134, 225, 289 and 303 | 121, 134, 225, 289 and 336 | 121, 134, 225, 303 and 336 |
| 121, 134, 229, 258 and 289 | 121, 134, 229, 258 and 303 | 121, 134, 229, 258 and 336 | 121, 134, 229, 289 and 303 | 121, 134, 229, 289 and 336 |
| 121, 134, 229, 303 and 336 | 121, 134, 258, 289 and 303 | 121, 134, 258, 289 and 336 | 121, 134, 258, 303 and 336 | 121, 134, 289, 303 and 336 |
| 121, 154, 190, 225 and 229 | 121, 154, 190, 225 and 258 | 121, 154, 190, 225 and 289 | 121, 154, 190, 225 and 303 | 121, 154, 190, 225 and 336 |
| 121, 154, 190, 229 and 258 | 121, 154, 190, 229 and 289 | 121, 154, 190, 229 and 303 | 121, 154, 190, 229 and 336 | 121, 154, 190, 258 and 289 |
| 121, 154, 190, 258 and 303 | 121, 154, 190, 258 and 336 | 121, 154, 190, 289 and 303 | 121, 154, 190, 289 and 336 | 121, 154, 190, 303 and 336 |
| 121, 154, 225, 229 and 258 | 121, 154, 225, 229 and 289 | 121, 154, 225, 229 and 303 | 121, 154, 225, 229 and 336 | 121, 154, 225, 258 and 289 |
| 121, 154, 225, 258 and 303 | 121, 154, 225, 258 and 336 | 121, 154, 225, 289 and 303 | 121, 154, 225, 289 and 336 | 121, 154, 225, 303 and 336 |
| 121, 154, 229, 258 and 289 | 121, 154, 229, 258 and 303 | 121, 154, 229, 258 and 336 | 121, 154, 229, 289 and 303 | 121, 154, 229, 289 and 336 |
| 121, 154, 229, 303 and 336 | 121, 154, 258, 289 and 303 | 121, 154, 258, 289 and 336 | 121, 154, 258, 303 and 336 | 121, 154, 289, 303 and 336 |
| 121, 190, 225, 229 and 258 | 121, 190, 225, 229 and 289 | 121, 190, 225, 229 and 303 | 121, 190, 225, 229 and 336 | 121, 190, 225, 258 and 289 |
| 121, 190, 225, 258 and 303 | 121, 190, 225, 258 and 336 | 121, 190, 225, 289 and 303 | 121, 190, 225, 289 and 336 | 121, 190, 225, 303 and 336 |
| 121, 190, 229, 258 and 289 | 121, 190, 229, 258 and 303 | 121, 190, 229, 258 and 336 | 121, 190, 229, 289 and 303 | 121, 190, 229, 289 and 336 |
| 121, 190, 229, 303 and 336 | 121, 190, 258, 289 and 303 | 121, 190, 258, 289 and 336 | 121, 190, 258, 303 and 336 | 121, 190, 289, 303 and 336 |
| 121, 225, 229, 258 and 289 | 121, 225, 229, 258 and 303 | 121, 225, 229, 258 and 336 | 121, 225, 229, 289 and 303 | 121, 225, 229, 289 and 336 |
| 121, 225, 229, 303 and 336 | 121, 225, 258, 289 and 303 | 121, 225, 258, 289 and 336 | 121, 225, 258, 303 and 336 | 121, 225, 289, 303 and 336 |
| 121, 229, 258, 289 and 303 | 121, 229, 258, 289 and 336 | 121, 229, 258, 303 and 336 | 121, 229, 289, 303 and 336 | 121, 258, 289, 303 and 336 |
| 130, 134, 154, 190 and 225 | 130, 134, 154, 190 and 229 | 130, 134, 154, 190 and 258 | 130, 134, 154, 190 and 289 | 130, 134, 154, 190 and 303 |
| 130, 134, 154, 190 and 336 | 130, 134, 154, 225 and 229 | 130, 134, 154, 225 and 258 | 130, 134, 154, 225 and 289 | 130, 134, 154, 225 and 303 |
| 130, 134, 154, 225 and 336 | 130, 134, 154, 229 and 258 | 130, 134, 154, 229 and 289 | 130, 134, 154, 229 and 303 | 130, 134, 154, 229 and 336 |
| 130, 134, 154, 258 and 289 | 130, 134, 154, 258 and 303 | 130, 134, 154, 258 and 336 | 130, 134, 154, 289 and 303 | 130, 134, 154, 289 and 336 |
| 130, 134, 154, 303 and 336 | 130, 134, 190, 225 and 229 | 130, 134, 190, 225 and 258 | 130, 134, 190, 225 and 289 | 130, 134, 190, 225 and 303 |
| 130, 134, 190, 225 and 336 | 130, 134, 190, 229 and 258 | 130, 134, 190, 229 and 289 | 130, 134, 190, 229 and 303 | 130, 134, 190, 229 and 336 |
| 130, 134, 190, 258 and 289 | 130, 134, 190, 258 and 303 | 130, 134, 190, 258 and 336 | 130, 134, 190, 289 and 303 | 130, 134, 190, 289 and 336 |
| 130, 134, 190, 303 and 336 | 130, 134, 225, 229 and 258 | 130, 134, 225, 229 and 289 | 130, 134, 225, 229 and 303 | 130, 134, 225, 229 and 336 |
| 130, 134, 225, 258 and 289 | 130, 134, 225, 258 and 303 | 130, 134, 225, 258 and 336 | 130, 134, 225, 289 and 303 | 130, 134, 225, 289 and 336 |
| 130, 134, 225, 303 and 336 | 130, 134, 229, 258 and 289 | 130, 134, 229, 258 and 303 | 130, 134, 229, 258 and 336 | 130, 134, 229, 289 and 303 |
| 130, 134, 229, 289 and 336 | 130, 134, 229, 303 and 336 | 130, 134, 258, 289 and 303 | 130, 134, 258, 289 and 336 | 130, 134, 258, 303 and 336 |
| 130, 134, 289, 303 and 336 | 130, 154, 190, 225 and 229 | 130, 154, 190, 225 and 258 | 130, 154, 190, 225 and 289 | 130, 154, 190, 225 and 303 |
| 130, 154, 190, 225 and 336 | 130, 154, 190, 229 and 258 | 130, 154, 190, 229 and 289 | 130, 154, 190, 229 and 303 | 130, 154, 190, 229 and 336 |
| 130, 154, 190, 258 and 289 | 130, 154, 190, 258 and 303 | 130, 154, 190, 258 and 336 | 130, 154, 190, 289 and 303 | 130, 154, 190, 289 and 336 |
| 130, 154, 190, 303 and 336 | 130, 154, 225, 229 and 258 | 130, 154, 225, 229 and 289 | 130, 154, 225, 229 and 303 | 130, 154, 225, 229 and 336 |
| 130, 154, 225, 258 and 289 | 130, 154, 225, 258 and 303 | 130, 154, 225, 258 and 336 | 130, 154, 225, 289 and 303 | 130, 154, 225, 289 and 336 |

TABLE 20-continued

| Non-limiting examples of positions that may comprise a mutation, or a set of mutations [as compared to SEQ ID NO: 35] | | | | |
|---|---|---|---|---|
| 130, 154, 225, 303 and 336 | 130, 154, 229, 258 and 289 | 130, 154, 229, 258 and 303 | 130, 154, 229, 258 and 336 | 130, 154, 229, 289 and 303 |
| 130, 154, 229, 289 and 336 | 130, 154, 229, 303 and 336 | 130, 154, 258, 289 and 303 | 130, 154, 258, 289 and 336 | 130, 154, 258, 303 and 336 |
| 130, 154, 289, 303 and 336 | 130, 190, 225, 229 and 258 | 130, 190, 225, 229 and 289 | 130, 190, 225, 229 and 303 | 130, 190, 225, 229 and 336 |
| 130, 190, 225, 258 and 289 | 130, 190, 225, 258 and 303 | 130, 190, 225, 258 and 336 | 130, 190, 225, 289 and 303 | 130, 190, 225, 289 and 336 |
| 130, 190, 225, 303 and 336 | 130, 190, 229, 258 and 289 | 130, 190, 229, 258 and 303 | 130, 190, 229, 258 and 336 | 130, 190, 229, 289 and 303 |
| 130, 190, 229, 289 and 336 | 130, 190, 229, 303 and 336 | 130, 190, 258, 289 and 303 | 130, 190, 258, 289 and 336 | 130, 190, 258, 303 and 336 |
| 130, 190, 289, 303 and 336 | 130, 225, 229, 258 and 289 | 130, 225, 229, 258 and 303 | 130, 225, 229, 258 and 336 | 130, 225, 229, 289 and 303 |
| 130, 225, 229, 289 and 336 | 130, 225, 229, 303 and 336 | 130, 225, 258, 289 and 303 | 130, 225, 258, 289 and 336 | 130, 225, 258, 303 and 336 |
| 130, 225, 289, 303 and 336 | 130, 229, 258, 289 and 303 | 130, 229, 258, 289 and 336 | 130, 229, 258, 303 and 336 | 130, 229, 289, 303 and 336 |
| 130, 258, 289, 303 and 336 | 134, 154, 190, 225 and 229 | 134, 154, 190, 225 and 258 | 134, 154, 190, 225 and 289 | 134, 154, 190, 225 and 303 |
| 134, 154, 190, 225 and 336 | 134, 154, 190, 229 and 258 | 134, 154, 190, 229 and 289 | 134, 154, 190, 229 and 303 | 134, 154, 190, 229 and 336 |
| 134, 154, 190, 258 and 289 | 134, 154, 190, 258 and 303 | 134, 154, 190, 258 and 336 | 134, 154, 190, 289 and 303 | 134, 154, 190, 289 and 336 |
| 134, 154, 190, 303 and 336 | 134, 154, 225, 229 and 258 | 134, 154, 225, 229 and 289 | 134, 154, 225, 229 and 303 | 134, 154, 225, 229 and 336 |
| 134, 154, 225, 258 and 289 | 134, 154, 225, 258 and 303 | 134, 154, 225, 258 and 336 | 134, 154, 225, 289 and 303 | 134, 154, 225, 289 and 336 |
| 134, 154, 225, 303 and 336 | 134, 154, 229, 258 and 289 | 134, 154, 229, 258 and 303 | 134, 154, 229, 258 and 336 | 134, 154, 229, 289 and 303 |
| 134, 154, 229, 289 and 336 | 134, 154, 229, 303 and 336 | 134, 154, 258, 289 and 303 | 134, 154, 258, 289 and 336 | 134, 154, 258, 303 and 336 |
| 134, 154, 289, 303 and 336 | 134, 190, 225, 229 and 258 | 134, 190, 225, 229 and 289 | 134, 190, 225, 229 and 303 | 134, 190, 225, 229 and 336 |
| 134, 190, 225, 258 and 289 | 134, 190, 225, 258 and 303 | 134, 190, 225, 258 and 336 | 134, 190, 225, 289 and 303 | 134, 190, 225, 289 and 336 |
| 134, 190, 225, 303 and 336 | 134, 190, 229, 258 and 289 | 134, 190, 229, 258 and 303 | 134, 190, 229, 258 and 336 | 134, 190, 229, 289 and 303 |
| 134, 190, 229, 289 and 336 | 134, 190, 229, 303 and 336 | 134, 190, 258, 289 and 303 | 134, 190, 258, 289 and 336 | 134, 190, 258, 303 and 336 |
| 134, 190, 289, 303 and 336 | 134, 225, 229, 258 and 289 | 134, 225, 229, 258 and 303 | 134, 225, 229, 258 and 336 | 134, 225, 229, 289 and 303 |
| 134, 225, 229, 289 and 336 | 134, 225, 229, 303 and 336 | 134, 225, 258, 289 and 303 | 134, 225, 258, 289 and 336 | 134, 225, 258, 303 and 336 |
| 134, 225, 289, 303 and 336 | 134, 229, 258, 289 and 303 | 134, 229, 258, 289 and 336 | 134, 229, 258, 303 and 336 | 134, 229, 289, 303 and 336 |
| 134, 258, 289, 303 and 336 | 154, 190, 225, 229 and 258 | 154, 190, 225, 229 and 289 | 154, 190, 225, 229 and 303 | 154, 190, 225, 229 and 336 |
| 154, 190, 225, 258 and 289 | 154, 190, 225, 258 and 303 | 154, 190, 225, 258 and 336 | 154, 190, 225, 289 and 303 | 154, 190, 225, 289 and 336 |
| 154, 190, 225, 303 and 336 | 154, 190, 229, 258 and 289 | 154, 190, 229, 258 and 303 | 154, 190, 229, 258 and 336 | 154, 190, 229, 289 and 303 |
| 154, 190, 229, 289 and 336 | 154, 190, 229, 303 and 336 | 154, 190, 258, 289 and 303 | 154, 190, 258, 289 and 336 | 154, 190, 258, 303 and 336 |
| 154, 190, 289, 303 and 336 | 154, 225, 229, 258 and 289 | 154, 225, 229, 258 and 303 | 154, 225, 229, 258 and 336 | 154, 225, 229, 289 and 303 |
| 154, 225, 229, 289 and 336 | 154, 225, 229, 303 and 336 | 154, 225, 258, 289 and 303 | 154, 225, 258, 289 and 336 | 154, 225, 258, 303 and 336 |
| 154, 225, 289, 303 and 336 | 154, 229, 258, 289 and 303 | 154, 229, 258, 289 and 336 | 154, 229, 258, 303 and 336 | 154, 229, 289, 303 and 336 |
| 154, 258, 289, 303 and 336 | 190, 225, 229, 258 and 289 | 190, 225, 229, 258 and 303 | 190, 225, 229, 258 and 336 | 190, 225, 229, 289 and 303 |
| 190, 225, 229, 289 and 336 | 190, 225, 229, 303 and 336 | 190, 225, 258, 289 and 303 | 190, 225, 258, 289 and 336 | 190, 225, 258, 303 and 336 |
| 190, 225, 289, 303 and 336 | 190, 229, 258, 289 and 303 | 190, 229, 258, 289 and 336 | 190, 229, 258, 303 and 336 | 190, 229, 289, 303 and 336 |
| 190, 258, 289, 303 and 336 | 225, 229, 258, 289 and 303 | 225, 229, 258, 289 and 336 | 225, 229, 258, 303 and 336 | 225, 229, 289, 303 and 336 |
| 225, 258, 289, 303 and 336 | 229, 258, 289, 303 and 336 | | | |
| 85, 121, 130, 134, 154 and 190 | 85, 121, 130, 134, 154 and 225 | 85, 121, 130, 134, 154 and 229 | 85, 121, 130, 134, 154 and 258 | 85, 121, 130, 134, 154 and 289 |
| 85, 121, 130, 134, 154 and 303 | 85, 121, 130, 134, 154 and 336 | 85, 121, 130, 134, 190 and 225 | 85, 121, 130, 134, 190 and 229 | 85, 121, 130, 134, 190 and 258 |
| 85, 121, 130, 134, 190 and 289 | 85, 121, 130, 134, 190 and 303 | 85, 121, 130, 134, 190 and 336 | 85, 121, 130, 134, 225 and 229 | 85, 121, 130, 134, 225 and 258 |
| 85, 121, 130, 134, 225 and 289 | 85, 121, 130, 134, 225 and 303 | 85, 121, 130, 134, 225 and 336 | 85, 121, 130, 134, 229 and 258 | 85, 121, 130, 134, 229 and 289 |

TABLE 20-continued

| Non-limiting examples of positions that may comprise a mutation, or a set of mutations [as compared to SEQ ID NO: 35] | | | | |
|---|---|---|---|---|
| 85, 121, 130, 134, 229 and 303 | 85, 121, 130, 134, 229 and 336 | 85, 121, 130, 134, 258 and 289 | 85, 121, 130, 134, 258 and 303 | 85, 121, 130, 134, 258 and 336 |
| 85, 121, 130, 134, 289 and 303 | 85, 121, 130, 134, 289 and 336 | 85, 121, 130, 134, 303 and 336 | 85, 121, 130, 154, 190 and 225 | 85, 121, 130, 154, 190 and 229 |
| 85, 121, 130, 154, 190 and 258 | 85, 121, 130, 154, 190 and 289 | 85, 121, 130, 154, 190 and 303 | 85, 121, 130, 154, 190 and 336 | 85, 121, 130, 154, 225 and 229 |
| 85, 121, 130, 154, 225 and 258 | 85, 121, 130, 154, 225 and 289 | 85, 121, 130, 154, 225 and 303 | 85, 121, 130, 154, 225 and 336 | 85, 121, 130, 154, 229 and 258 |
| 85, 121, 130, 154, 229 and 289 | 85, 121, 130, 154, 229 and 303 | 85, 121, 130, 154, 229 and 336 | 85, 121, 130, 154, 258 and 289 | 85, 121, 130, 154, 258 and 303 |
| 85, 121, 130, 154, 258 and 336 | 85, 121, 130, 154, 289 and 303 | 85, 121, 130, 154, 289 and 336 | 85, 121, 130, 154, 303 and 336 | 85, 121, 130, 190, 225 and 229 |
| 85, 121, 130, 190, 225 and 258 | 85, 121, 130, 190, 225 and 289 | 85, 121, 130, 190, 225 and 303 | 85, 121, 130, 190, 225 and 336 | 85, 121, 130, 190, 229 and 258 |
| 85, 121, 130, 190, 229 and 289 | 85, 121, 130, 190, 229 and 303 | 85, 121, 130, 190, 229 and 336 | 85, 121, 130, 190, 258 and 289 | 85, 121, 130, 190, 258 and 303 |
| 85, 121, 130, 190, 258 and 336 | 85, 121, 130, 190, 289 and 303 | 85, 121, 130, 190, 289 and 336 | 85, 121, 130, 190, 303 and 336 | 85, 121, 130, 225, 229 and 258 |
| 85, 121, 130, 225, 229 and 289 | 85, 121, 130, 225, 229 and 303 | 85, 121, 130, 225, 229 and 336 | 85, 121, 130, 225, 258 and 289 | 85, 121, 130, 225, 258 and 303 |
| 85, 121, 130, 225, 258 and 336 | 85, 121, 130, 225, 289 and 303 | 85, 121, 130, 225, 289 and 336 | 85, 121, 130, 225, 303 and 336 | 85, 121, 130, 229, 258 and 289 |
| 85, 121, 130, 229, 258 and 303 | 85, 121, 130, 229, 258 and 336 | 85, 121, 130, 229, 289 and 303 | 85, 121, 130, 229, 289 and 336 | 85, 121, 130, 229, 303 and 336 |
| 85, 121, 130, 258, 289 and 303 | 85, 121, 130, 258, 289 and 336 | 85, 121, 130, 258, 303 and 336 | 85, 121, 130, 289, 303 and 336 | 85, 121, 134, 154, 190 and 225 |
| 85, 121, 134, 154, 190 and 229 | 85, 121, 134, 154, 190 and 258 | 85, 121, 134, 154, 190 and 289 | 85, 121, 134, 154, 190 and 303 | 85, 121, 134, 154, 190 and 336 |
| 85, 121, 134, 154, 225 and 229 | 85, 121, 134, 154, 225 and 258 | 85, 121, 134, 154, 225 and 289 | 85, 121, 134, 154, 225 and 303 | 85, 121, 134, 154, 225 and 336 |
| 85, 121, 134, 154, 229 and 258 | 85, 121, 134, 154, 229 and 289 | 85, 121, 134, 154, 229 and 303 | 85, 121, 134, 154, 229 and 336 | 85, 121, 134, 154, 258 and 289 |
| 85, 121, 134, 154, 258 and 303 | 85, 121, 134, 154, 258 and 336 | 85, 121, 134, 154, 289 and 303 | 85, 121, 134, 154, 289 and 336 | 85, 121, 134, 154, 303 and 336 |
| 85, 121, 134, 190, 225 and 229 | 85, 121, 134, 190, 225 and 258 | 85, 121, 134, 190, 225 and 289 | 85, 121, 134, 190, 225 and 303 | 85, 121, 134, 190, 225 and 336 |
| 85, 121, 134, 190, 229 and 258 | 85, 121, 134, 190, 229 and 289 | 85, 121, 134, 190, 229 and 303 | 85, 121, 134, 190, 229 and 336 | 85, 121, 134, 190, 258 and 289 |
| 85, 121, 134, 190, 258 and 303 | 85, 121, 134, 190, 258 and 336 | 85, 121, 134, 190, 289 and 303 | 85, 121, 134, 190, 289 and 336 | 85, 121, 134, 190, 303 and 336 |
| 85, 121, 134, 225, 229 and 258 | 85, 121, 134, 225, 229 and 289 | 85, 121, 134, 225, 229 and 303 | 85, 121, 134, 225, 229 and 336 | 85, 121, 134, 225, 258 and 289 |
| 85, 121, 134, 225, 258 and 303 | 85, 121, 134, 225, 258 and 336 | 85, 121, 134, 225, 289 and 303 | 85, 121, 134, 225, 289 and 336 | 85, 121, 134, 225, 303 and 336 |
| 85, 121, 134, 229, 258 and 289 | 85, 121, 134, 229, 258 and 303 | 85, 121, 134, 229, 258 and 336 | 85, 121, 134, 229, 289 and 303 | 85, 121, 134, 229, 289 and 336 |
| 85, 121, 134, 229, 303 and 336 | 85, 121, 134, 258, 289 and 303 | 85, 121, 134, 258, 289 and 336 | 85, 121, 134, 258, 303 and 336 | 85, 121, 134, 289, 303 and 336 |
| 85, 121, 154, 190, 225 and 229 | 85, 121, 154, 190, 225 and 258 | 85, 121, 154, 190, 225 and 289 | 85, 121, 154, 190, 225 and 303 | 85, 121, 154, 190, 225 and 336 |
| 85, 121, 154, 190, 229 and 258 | 85, 121, 154, 190, 229 and 289 | 85, 121, 154, 190, 229 and 303 | 85, 121, 154, 190, 229 and 336 | 85, 121, 154, 190, 258 and 289 |
| 85, 121, 154, 190, 258 and 303 | 85, 121, 154, 190, 258 and 336 | 85, 121, 154, 190, 289 and 303 | 85, 121, 154, 190, 289 and 336 | 85, 121, 154, 190, 303 and 336 |
| 85, 121, 154, 225, 229 and 258 | 85, 121, 154, 225, 229 and 289 | 85, 121, 154, 225, 229 and 303 | 85, 121, 154, 225, 229 and 336 | 85, 121, 154, 225, 258 and 289 |
| 85, 121, 154, 225, 258 and 303 | 85, 121, 154, 225, 258 and 336 | 85, 121, 154, 225, 289 and 303 | 85, 121, 154, 225, 289 and 336 | 85, 121, 154, 225, 303 and 336 |
| 85, 121, 154, 229, 258 and 289 | 85, 121, 154, 229, 258 and 303 | 85, 121, 154, 229, 258 and 336 | 85, 121, 154, 229, 289 and 303 | 85, 121, 154, 229, 289 and 336 |
| 85, 121, 154, 229, 303 and 336 | 85, 121, 154, 258, 289 and 303 | 85, 121, 154, 258, 289 and 336 | 85, 121, 154, 258, 303 and 336 | 85, 121, 154, 289, 303 and 336 |
| 85, 121, 190, 225, 229 and 258 | 85, 121, 190, 225, 229 and 289 | 85, 121, 190, 225, 229 and 303 | 85, 121, 190, 225, 229 and 336 | 85, 121, 190, 225, 258 and 289 |
| 85, 121, 190, 225, 258 and 303 | 85, 121, 190, 225, 258 and 336 | 85, 121, 190, 225, 289 and 303 | 85, 121, 190, 225, 289 and 336 | 85, 121, 190, 225, 303 and 336 |
| 85, 121, 190, 229, 258 and 289 | 85, 121, 190, 229, 258 and 303 | 85, 121, 190, 229, 258 and 336 | 85, 121, 190, 229, 289 and 303 | 85, 121, 190, 229, 289 and 336 |
| 85, 121, 190, 229, 303 and 336 | 85, 121, 190, 258, 289 and 303 | 85, 121, 190, 258, 289 and 336 | 85, 121, 190, 258, 303 and 336 | 85, 121, 190, 289, 303 and 336 |
| 85, 121, 225, 229, 258 and 289 | 85, 121, 225, 229, 258 and 303 | 85, 121, 225, 229, 258 and 336 | 85, 121, 225, 229, 289 and 303 | 85, 121, 225, 229, 289 and 336 |
| 85, 121, 225, 229, 303 and 336 | 85, 121, 225, 258, 289 and 303 | 85, 121, 225, 258, 289 and 336 | 85, 121, 225, 258, 303 and 336 | 85, 121, 225, 289, 303 and 336 |
| 85, 121, 229, 258, 289 and 303 | 85, 121, 229, 258, 289 and 336 | 85, 121, 229, 258, 303 and 336 | 85, 121, 229, 289, 303 and 336 | 85, 121, 258, 289, 303 and 336 |
| 85, 130, 134, 154, 190 and 225 | 85, 130, 134, 154, 190 and 229 | 85, 130, 134, 154, 190 and 258 | 85, 130, 134, 154, 190 and 289 | 85, 130, 134, 154, 190 and 303 |

TABLE 20-continued

| Non-limiting examples of positions that may comprise a mutation, or a set of mutations [as compared to SEQ ID NO: 35] | | | | |
|---|---|---|---|---|
| 85, 130, 134, 154, 190 and 336 | 85, 130, 134, 154, 225 and 229 | 85, 130, 134, 154, 225 and 258 | 85, 130, 134, 154, 225 and 289 | 85, 130, 134, 154, 225 and 303 |
| 85, 130, 134, 154, 225 and 336 | 85, 130, 134, 154, 229 and 258 | 85, 130, 134, 154, 229 and 289 | 85, 130, 134, 154, 229 and 303 | 85, 130, 134, 154, 229 and 336 |
| 85, 130, 134, 154, 258 and 289 | 85, 130, 134, 154, 258 and 303 | 85, 130, 134, 154, 258 and 336 | 85, 130, 134, 154, 289 and 303 | 85, 130, 134, 154, 289 and 336 |
| 85, 130, 134, 154, 303 and 336 | 85, 130, 134, 190, 225 and 229 | 85, 130, 134, 190, 225 and 258 | 85, 130, 134, 190, 225 and 289 | 85, 130, 134, 190, 225 and 303 |
| 85, 130, 134, 190, 225 and 336 | 85, 130, 134, 190, 229 and 258 | 85, 130, 134, 190, 229 and 289 | 85, 130, 134, 190, 229 and 303 | 85, 130, 134, 190, 229 and 336 |
| 85, 130, 134, 190, 258 and 289 | 85, 130, 134, 190, 258 and 303 | 85, 130, 134, 190, 258 and 336 | 85, 130, 134, 190, 289 and 303 | 85, 130, 134, 190, 289 and 336 |
| 85, 130, 134, 190, 303 and 336 | 85, 130, 134, 225, 229 and 258 | 85, 130, 134, 225, 229 and 289 | 85, 130, 134, 225, 229 and 303 | 85, 130, 134, 225, 229 and 336 |
| 85, 130, 134, 225, 258 and 289 | 85, 130, 134, 225, 258 and 303 | 85, 130, 134, 225, 258 and 336 | 85, 130, 134, 225, 289 and 303 | 85, 130, 134, 225, 289 and 336 |
| 85, 130, 134, 225, 303 and 336 | 85, 130, 134, 229, 258 and 289 | 85, 130, 134, 229, 258 and 303 | 85, 130, 134, 229, 258 and 336 | 85, 130, 134, 229, 289 and 303 |
| 85, 130, 134, 229, 289 and 336 | 85, 130, 134, 229, 303 and 336 | 85, 130, 134, 258, 289 and 303 | 85, 130, 134, 258, 289 and 336 | 85, 130, 134, 258, 303 and 336 |
| 85, 130, 134, 289, 303 and 336 | 85, 130, 154, 190, 225 and 229 | 85, 130, 154, 190, 225 and 258 | 85, 130, 154, 190, 225 and 289 | 85, 130, 154, 190, 225 and 303 |
| 85, 130, 154, 190, 225 and 336 | 85, 130, 154, 190, 229 and 258 | 85, 130, 154, 190, 229 and 289 | 85, 130, 154, 190, 229 and 303 | 85, 130, 154, 190, 229 and 336 |
| 85, 130, 154, 190, 258 and 289 | 85, 130, 154, 190, 258 and 303 | 85, 130, 154, 190, 258 and 336 | 85, 130, 154, 190, 289 and 303 | 85, 130, 154, 190, 289 and 336 |
| 85, 130, 154, 190, 303 and 336 | 85, 130, 154, 225, 229 and 258 | 85, 130, 154, 225, 229 and 289 | 85, 130, 154, 225, 229 and 303 | 85, 130, 154, 225, 229 and 336 |
| 85, 130, 154, 225, 258 and 289 | 85, 130, 154, 225, 258 and 303 | 85, 130, 154, 225, 258 and 336 | 85, 130, 154, 225, 289 and 303 | 85, 130, 154, 225, 289 and 336 |
| 85, 130, 154, 225, 303 and 336 | 85, 130, 154, 229, 258 and 289 | 85, 130, 154, 229, 258 and 303 | 85, 130, 154, 229, 258 and 336 | 85, 130, 154, 229, 289 and 303 |
| 85, 130, 154, 229, 289 and 336 | 85, 130, 154, 229, 303 and 336 | 85, 130, 154, 258, 289 and 303 | 85, 130, 154, 258, 289 and 336 | 85, 130, 154, 258, 303 and 336 |
| 85, 130, 154, 289, 303 and 336 | 85, 130, 190, 225, 229 and 258 | 85, 130, 190, 225, 229 and 289 | 85, 130, 190, 225, 229 and 303 | 85, 130, 190, 225, 229 and 336 |
| 85, 130, 190, 225, 258 and 289 | 85, 130, 190, 225, 258 and 303 | 85, 130, 190, 225, 258 and 336 | 85, 130, 190, 225, 289 and 303 | 85, 130, 190, 225, 289 and 336 |
| 85, 130, 190, 225, 303 and 336 | 85, 130, 190, 229, 258 and 289 | 85, 130, 190, 229, 258 and 303 | 85, 130, 190, 229, 258 and 336 | 85, 130, 190, 229, 289 and 303 |
| 85, 130, 190, 229, 289 and 336 | 85, 130, 190, 229, 303 and 336 | 85, 130, 190, 258, 289 and 303 | 85, 130, 190, 258, 289 and 336 | 85, 130, 190, 258, 303 and 336 |
| 85, 130, 190, 289, 303 and 336 | 85, 130, 225, 229, 258 and 289 | 85, 130, 225, 229, 258 and 303 | 85, 130, 225, 229, 258 and 336 | 85, 130, 225, 229, 289 and 303 |
| 85, 130, 225, 229, 289 and 336 | 85, 130, 225, 229, 303 and 336 | 85, 130, 225, 258, 289 and 303 | 85, 130, 225, 258, 289 and 336 | 85, 130, 225, 258, 303 and 336 |
| 85, 130, 225, 289, 303 and 336 | 85, 130, 229, 258, 289 and 303 | 85, 130, 229, 258, 289 and 336 | 85, 130, 229, 258, 303 and 336 | 85, 130, 229, 289, 303 and 336 |
| 85, 130, 258, 289, 303 and 336 | 85, 134, 154, 190, 225 and 229 | 85, 134, 154, 190, 225 and 258 | 85, 134, 154, 190, 225 and 289 | 85, 134, 154, 190, 225 and 303 |
| 85, 134, 154, 190, 225 and 336 | 85, 134, 154, 190, 229 and 258 | 85, 134, 154, 190, 229 and 289 | 85, 134, 154, 190, 229 and 303 | 85, 134, 154, 190, 229 and 336 |
| 85, 134, 154, 190, 258 and 289 | 85, 134, 154, 190, 258 and 303 | 85, 134, 154, 190, 258 and 336 | 85, 134, 154, 190, 289 and 303 | 85, 134, 154, 190, 289 and 336 |
| 85, 134, 154, 190, 303 and 336 | 85, 134, 154, 225, 229 and 258 | 85, 134, 154, 225, 229 and 289 | 85, 134, 154, 225, 229 and 303 | 85, 134, 154, 225, 229 and 336 |
| 85, 134, 154, 225, 258 and 289 | 85, 134, 154, 225, 258 and 303 | 85, 134, 154, 225, 258 and 336 | 85, 134, 154, 225, 289 and 303 | 85, 134, 154, 225, 289 and 336 |
| 85, 134, 154, 225, 303 and 336 | 85, 134, 154, 229, 258 and 289 | 85, 134, 154, 229, 258 and 303 | 85, 134, 154, 229, 258 and 336 | 85, 134, 154, 229, 289 and 303 |
| 85, 134, 154, 229, 289 and 336 | 85, 134, 154, 229, 303 and 336 | 85, 134, 154, 258, 289 and 303 | 85, 134, 154, 258, 289 and 336 | 85, 134, 154, 258, 303 and 336 |
| 85, 134, 154, 289, 303 and 336 | 85, 134, 190, 225, 229 and 258 | 85, 134, 190, 225, 229 and 289 | 85, 134, 190, 225, 229 and 303 | 85, 134, 190, 225, 229 and 336 |
| 85, 134, 190, 225, 258 and 289 | 85, 134, 190, 225, 258 and 303 | 85, 134, 190, 225, 258 and 336 | 85, 134, 190, 225, 289 and 303 | 85, 134, 190, 225, 289 and 336 |
| 85, 134, 190, 225, 303 and 336 | 85, 134, 190, 229, 258 and 289 | 85, 134, 190, 229, 258 and 303 | 85, 134, 190, 229, 258 and 336 | 85, 134, 190, 229, 289 and 303 |
| 85, 134, 190, 229, 289 and 336 | 85, 134, 190, 229, 303 and 336 | 85, 134, 190, 258, 289 and 303 | 85, 134, 190, 258, 289 and 336 | 85, 134, 190, 258, 303 and 336 |
| 85, 134, 190, 289, 303 and 336 | 85, 134, 225, 229, 258 and 289 | 85, 134, 225, 229, 258 and 303 | 85, 134, 225, 229, 258 and 336 | 85, 134, 225, 229, 289 and 303 |
| 85, 134, 225, 229, 289 and 336 | 85, 134, 225, 229, 303 and 336 | 85, 134, 225, 258, 289 and 303 | 85, 134, 225, 258, 289 and 336 | 85, 134, 225, 258, 303 and 336 |
| 85, 134, 225, 289, 303 and 336 | 85, 134, 229, 258, 289 and 303 | 85, 134, 229, 258, 289 and 336 | 85, 134, 229, 258, 303 and 336 | 85, 134, 229, 289, 303 and 336 |
| 85, 134, 258, 289, 303 and 336 | 85, 154, 190, 225, 229 and 258 | 85, 154, 190, 225, 229 and 289 | 85, 154, 190, 225, 229 and 303 | 85, 154, 190, 225, 229 and 336 |

TABLE 20-continued

| Non-limiting examples of positions that may comprise a mutation, or a set of mutations [as compared to SEQ ID NO: 35] | | | | |
|---|---|---|---|---|
| 85, 154, 190, 225, 258 and 289 | 85, 154, 190, 225, 258 and 303 | 85, 154, 190, 225, 258 and 336 | 85, 154, 190, 225, 289 and 303 | 85, 154, 190, 225, 289 and 336 |
| 85, 154, 190, 225, 303 and 336 | 85, 154, 190, 229, 258 and 289 | 85, 154, 190, 229, 258 and 303 | 85, 154, 190, 229, 258 and 336 | 85, 154, 190, 229, 289 and 303 |
| 85, 154, 190, 229, 289 and 336 | 85, 154, 190, 229, 303 and 336 | 85, 154, 190, 258, 289 and 303 | 85, 154, 190, 258, 289 and 336 | 85, 154, 190, 258, 303 and 336 |
| 85, 154, 190, 289, 303 and 336 | 85, 154, 225, 229, 258 and 289 | 85, 154, 225, 229, 258 and 303 | 85, 154, 225, 229, 258 and 336 | 85, 154, 225, 229, 289 and 303 |
| 85, 154, 225, 229, 289 and 336 | 85, 154, 225, 229, 303 and 336 | 85, 154, 225, 258, 289 and 303 | 85, 154, 225, 258, 289 and 336 | 85, 154, 225, 258, 303 and 336 |
| 85, 154, 225, 289, 303 and 336 | 85, 154, 229, 258, 289 and 303 | 85, 154, 229, 258, 289 and 336 | 85, 154, 229, 258, 303 and 336 | 85, 154, 229, 289, 303 and 336 |
| 85, 154, 258, 289, 303 and 336 | 85, 190, 225, 229, 258 and 289 | 85, 190, 225, 229, 258 and 303 | 85, 190, 225, 229, 258 and 336 | 85, 190, 225, 229, 289 and 303 |
| 85, 190, 225, 229, 289 and 336 | 85, 190, 225, 229, 303 and 336 | 85, 190, 225, 258, 289 and 303 | 85, 190, 225, 258, 289 and 336 | 85, 190, 225, 258, 303 and 336 |
| 85, 190, 225, 289, 303 and 336 | 85, 190, 229, 258, 289 and 303 | 85, 190, 229, 258, 289 and 336 | 85, 190, 229, 258, 303 and 336 | 85, 190, 229, 289, 303 and 336 |
| 85, 190, 258, 289, 303 and 336 | 85, 225, 229, 258, 289 and 303 | 85, 225, 229, 258, 289 and 336 | 85, 225, 229, 258, 303 and 336 | 85, 225, 229, 289, 303 and 336 |
| 85, 225, 258, 289, 303 and 336 | 85, 229, 258, 289, 303 and 336 | 121, 130, 134, 154, 190 and 225 | 121, 130, 134, 154, 190 and 229 | 121, 130, 134, 154, 190 and 258 |
| 121, 130, 134, 154, 190 and 289 | 121, 130, 134, 154, 190 and 303 | 121, 130, 134, 154, 190 and 336 | 121, 130, 134, 154, 225 and 229 | 121, 130, 134, 154, 225 and 258 |
| 121, 130, 134, 154, 225 and 289 | 121, 130, 134, 154, 225 and 303 | 121, 130, 134, 154, 225 and 336 | 121, 130, 134, 154, 229 and 258 | 121, 130, 134, 154, 229 and 289 |
| 121, 130, 134, 154, 229 and 303 | 121, 130, 134, 154, 229 and 336 | 121, 130, 134, 154, 258 and 289 | 121, 130, 134, 154, 258 and 303 | 121, 130, 134, 154, 258 and 336 |
| 121, 130, 134, 154, 289 and 303 | 121, 130, 134, 154, 289 and 336 | 121, 130, 134, 154, 303 and 336 | 121, 130, 134, 190, 225 and 229 | 121, 130, 134, 190, 225 and 258 |
| 121, 130, 134, 190, 225 and 289 | 121, 130, 134, 190, 225 and 303 | 121, 130, 134, 190, 225 and 336 | 121, 130, 134, 190, 229 and 258 | 121, 130, 134, 190, 229 and 289 |
| 121, 130, 134, 190, 229 and 303 | 121, 130, 134, 190, 229 and 336 | 121, 130, 134, 190, 258 and 289 | 121, 130, 134, 190, 258 and 303 | 121, 130, 134, 190, 258 and 336 |
| 121, 130, 134, 190, 289 and 303 | 121, 130, 134, 190, 289 and 336 | 121, 130, 134, 190, 303 and 336 | 121, 130, 134, 225, 229 and 258 | 121, 130, 134, 225, 229 and 289 |
| 121, 130, 134, 225, 229 and 303 | 121, 130, 134, 225, 229 and 336 | 121, 130, 134, 225, 258 and 289 | 121, 130, 134, 225, 258 and 303 | 121, 130, 134, 225, 258 and 336 |
| 121, 130, 134, 225, 289 and 303 | 121, 130, 134, 225, 289 and 336 | 121, 130, 134, 225, 303 and 336 | 121, 130, 134, 229, 258 and 289 | 121, 130, 134, 229, 258 and 303 |
| 121, 130, 134, 229, 258 and 336 | 121, 130, 134, 229, 289 and 303 | 121, 130, 134, 229, 289 and 336 | 121, 130, 134, 229, 303 and 336 | 121, 130, 134, 258, 289 and 303 |
| 121, 130, 134, 258, 289 and 336 | 121, 130, 134, 258, 303 and 336 | 121, 130, 134, 289, 303 and 336 | 121, 130, 154, 190, 225 and 229 | 121, 130, 154, 190, 225 and 258 |
| 121, 130, 154, 190, 225 and 289 | 121, 130, 154, 190, 225 and 303 | 121, 130, 154, 190, 225 and 336 | 121, 130, 154, 190, 229 and 258 | 121, 130, 154, 190, 229 and 289 |
| 121, 130, 154, 190, 229 and 303 | 121, 130, 154, 190, 229 and 336 | 121, 130, 154, 190, 258 and 289 | 121, 130, 154, 190, 258 and 303 | 121, 130, 154, 190, 258 and 336 |
| 121, 130, 154, 190, 289 and 303 | 121, 130, 154, 190, 289 and 336 | 121, 130, 154, 190, 303 and 336 | 121, 130, 154, 225, 229 and 258 | 121, 130, 154, 225, 229 and 289 |
| 121, 130, 154, 225, 229 and 303 | 121, 130, 154, 225, 229 and 336 | 121, 130, 154, 225, 258 and 289 | 121, 130, 154, 225, 258 and 303 | 121, 130, 154, 225, 258 and 336 |
| 121, 130, 154, 225, 289 and 303 | 121, 130, 154, 225, 289 and 336 | 121, 130, 154, 225, 303 and 336 | 121, 130, 154, 229, 258 and 289 | 121, 130, 154, 229, 258 and 303 |
| 121, 130, 154, 229, 258 and 336 | 121, 130, 154, 229, 289 and 303 | 121, 130, 154, 229, 289 and 336 | 121, 130, 154, 229, 303 and 336 | 121, 130, 154, 258, 289 and 303 |
| 121, 130, 154, 258, 289 and 336 | 121, 130, 154, 258, 303 and 336 | 121, 130, 154, 289, 303 and 336 | 121, 130, 190, 225, 229 and 258 | 121, 130, 190, 225, 229 and 289 |
| 121, 130, 190, 225, 229 and 303 | 121, 130, 190, 225, 229 and 336 | 121, 130, 190, 225, 258 and 289 | 121, 130, 190, 225, 258 and 303 | 121, 130, 190, 225, 258 and 336 |
| 121, 130, 190, 225, 289 and 303 | 121, 130, 190, 225, 289 and 336 | 121, 130, 190, 225, 303 and 336 | 121, 130, 190, 229, 258 and 289 | 121, 130, 190, 229, 258 and 303 |
| 121, 130, 190, 229, 258 and 336 | 121, 130, 190, 229, 289 and 303 | 121, 130, 190, 229, 289 and 336 | 121, 130, 190, 229, 303 and 336 | 121, 130, 190, 258, 289 and 303 |
| 121, 130, 190, 258, 289 and 336 | 121, 130, 190, 258, 303 and 336 | 121, 130, 190, 289, 303 and 336 | 121, 130, 225, 229, 258 and 289 | 121, 130, 225, 229, 258 and 303 |
| 121, 130, 225, 229, 258 and 336 | 121, 130, 225, 229, 289 and 303 | 121, 130, 225, 229, 289 and 336 | 121, 130, 225, 229, 303 and 336 | 121, 130, 225, 258, 289 and 303 |
| 121, 130, 225, 258, 289 and 336 | 121, 130, 225, 258, 303 and 336 | 121, 130, 225, 289, 303 and 336 | 121, 130, 229, 258, 289 and 303 | 121, 130, 229, 258, 289 and 336 |
| 121, 130, 229, 258, 303 and 336 | 121, 130, 229, 289, 303 and 336 | 121, 130, 258, 289, 303 and 336 | 121, 134, 154, 190, 225 and 229 | 121, 134, 154, 190, 225 and 258 |
| 121, 134, 154, 190, 225 and 289 | 121, 134, 154, 190, 225 and 303 | 121, 134, 154, 190, 225 and 336 | 121, 134, 154, 190, 229 and 258 | 121, 134, 154, 190, 229 and 289 |
| 121, 134, 154, 190, 229 and 303 | 121, 134, 154, 190, 229 and 336 | 121, 134, 154, 190, 258 and 289 | 121, 134, 154, 190, 258 and 303 | 121, 134, 154, 190, 258 and 336 |
| 121, 134, 154, 190, 289 and 303 | 121, 134, 154, 190, 289 and 336 | 121, 134, 154, 190, 303 and 336 | 121, 134, 154, 225, 229 and 258 | 121, 134, 154, 225, 229 and 289 |

TABLE 20-continued

| Non-limiting examples of positions that may comprise a mutation, or a set of mutations [as compared to SEQ ID NO: 35] | | | | |
|---|---|---|---|---|
| 121, 134, 154, 225, 229 and 303 | 121, 134, 154, 225, 229 and 336 | 121, 134, 154, 225, 258 and 289 | 121, 134, 154, 225, 258 and 303 | 121, 134, 154, 225, 258 and 336 |
| 121, 134, 154, 225, 289 and 303 | 121, 134, 154, 225, 289 and 336 | 121, 134, 154, 225, 303 and 336 | 121, 134, 154, 229, 258 and 289 | 121, 134, 154, 229, 258 and 303 |
| 121, 134, 154, 229, 258 and 336 | 121, 134, 154, 229, 289 and 303 | 121, 134, 154, 229, 289 and 336 | 121, 134, 154, 229, 303 and 336 | 121, 134, 154, 258, 289 and 303 |
| 121, 134, 154, 258, 289 and 336 | 121, 134, 154, 258, 303 and 336 | 121, 134, 154, 289, 303 and 336 | 121, 134, 190, 225, 229 and 258 | 121, 134, 190, 225, 229 and 289 |
| 121, 134, 190, 225, 229 and 303 | 121, 134, 190, 225, 229 and 336 | 121, 134, 190, 225, 258 and 289 | 121, 134, 190, 225, 258 and 303 | 121, 134, 190, 225, 258 and 336 |
| 121, 134, 190, 225, 289 and 303 | 121, 134, 190, 225, 289 and 336 | 121, 134, 190, 225, 303 and 336 | 121, 134, 190, 229, 258 and 289 | 121, 134, 190, 229, 258 and 303 |
| 121, 134, 190, 229, 258 and 336 | 121, 134, 190, 229, 289 and 303 | 121, 134, 190, 229, 289 and 336 | 121, 134, 190, 229, 303 and 336 | 121, 134, 190, 258, 289 and 303 |
| 121, 134, 190, 258, 289 and 336 | 121, 134, 190, 258, 303 and 336 | 121, 134, 190, 289, 303 and 336 | 121, 134, 225, 229, 258 and 289 | 121, 134, 225, 229, 258 and 303 |
| 121, 134, 225, 229, 258 and 336 | 121, 134, 225, 229, 289 and 303 | 121, 134, 225, 229, 289 and 336 | 121, 134, 225, 229, 303 and 336 | 121, 134, 225, 258, 289 and 303 |
| 121, 134, 225, 258, 289 and 336 | 121, 134, 225, 258, 303 and 336 | 121, 134, 225, 289, 303 and 336 | 121, 134, 229, 258, 289 and 303 | 121, 134, 229, 258, 289 and 336 |
| 121, 134, 229, 258, 303 and 336 | 121, 134, 229, 289, 303 and 336 | 121, 134, 258, 289, 303 and 336 | 121, 154, 190, 225, 229 and 258 | 121, 154, 190, 225, 229 and 289 |
| 121, 154, 190, 225, 229 and 303 | 121, 154, 190, 225, 229 and 336 | 121, 154, 190, 225, 258 and 289 | 121, 154, 190, 225, 258 and 303 | 121, 154, 190, 225, 258 and 336 |
| 121, 154, 190, 225, 289 and 303 | 121, 154, 190, 225, 289 and 336 | 121, 154, 190, 225, 303 and 336 | 121, 154, 190, 229, 258 and 289 | 121, 154, 190, 229, 258 and 303 |
| 121, 154, 190, 229, 258 and 336 | 121, 154, 190, 229, 289 and 303 | 121, 154, 190, 229, 289 and 336 | 121, 154, 190, 229, 303 and 336 | 121, 154, 190, 258, 289 and 303 |
| 121, 154, 190, 258, 289 and 336 | 121, 154, 190, 258, 303 and 336 | 121, 154, 190, 289, 303 and 336 | 121, 154, 225, 229, 258 and 289 | 121, 154, 225, 229, 258 and 303 |
| 121, 154, 225, 229, 258 and 336 | 121, 154, 225, 229, 289 and 303 | 121, 154, 225, 229, 289 and 336 | 121, 154, 225, 229, 303 and 336 | 121, 154, 225, 258, 289 and 303 |
| 121, 154, 225, 258, 289 and 336 | 121, 154, 225, 258, 303 and 336 | 121, 154, 225, 289, 303 and 336 | 121, 154, 229, 258, 289 and 303 | 121, 154, 229, 258, 289 and 336 |
| 121, 154, 229, 258, 303 and 336 | 121, 154, 229, 289, 303 and 336 | 121, 154, 258, 289, 303 and 336 | 121, 190, 225, 229, 258 and 289 | 121, 190, 225, 229, 258 and 303 |
| 121, 190, 225, 229, 258 and 336 | 121, 190, 225, 229, 289 and 303 | 121, 190, 225, 229, 289 and 336 | 121, 190, 225, 229, 303 and 336 | 121, 190, 225, 258, 289 and 303 |
| 121, 190, 225, 258, 289 and 336 | 121, 190, 225, 258, 303 and 336 | 121, 190, 225, 289, 303 and 336 | 121, 190, 229, 258, 289 and 303 | 121, 190, 229, 258, 289 and 336 |
| 121, 190, 229, 258, 303 and 336 | 121, 190, 229, 289, 303 and 336 | 121, 190, 258, 289, 303 and 336 | 121, 225, 229, 258, 289 and 303 | 121, 225, 229, 258, 289 and 336 |
| 121, 225, 229, 258, 303 and 336 | 121, 225, 229, 289, 303 and 336 | 121, 225, 258, 289, 303 and 336 | 121, 229, 258, 289, 303 and 336 | 130, 134, 154, 190, 225 and 229 |
| 130, 134, 154, 190, 225 and 258 | 130, 134, 154, 190, 225 and 289 | 130, 134, 154, 190, 225 and 303 | 130, 134, 154, 190, 225 and 336 | 130, 134, 154, 190, 229 and 258 |
| 130, 134, 154, 190, 229 and 289 | 130, 134, 154, 190, 229 and 303 | 130, 134, 154, 190, 229 and 336 | 130, 134, 154, 190, 258 and 289 | 130, 134, 154, 190, 258 and 303 |
| 130, 134, 154, 190, 258 and 336 | 130, 134, 154, 190, 289 and 303 | 130, 134, 154, 190, 289 and 336 | 130, 134, 154, 190, 303 and 336 | 130, 134, 154, 225, 229 and 258 |
| 130, 134, 154, 225, 229 and 289 | 130, 134, 154, 225, 229 and 303 | 130, 134, 154, 225, 229 and 336 | 130, 134, 154, 225, 258 and 289 | 130, 134, 154, 225, 258 and 303 |
| 130, 134, 154, 225, 258 and 336 | 130, 134, 154, 225, 289 and 303 | 130, 134, 154, 225, 289 and 336 | 130, 134, 154, 225, 303 and 336 | 130, 134, 154, 229, 258 and 289 |
| 130, 134, 154, 229, 258 and 303 | 130, 134, 154, 229, 258 and 336 | 130, 134, 154, 229, 289 and 303 | 130, 134, 154, 229, 289 and 336 | 130, 134, 154, 229, 303 and 336 |
| 130, 134, 154, 258, 289 and 303 | 130, 134, 154, 258, 289 and 336 | 130, 134, 154, 258, 303 and 336 | 130, 134, 154, 289, 303 and 336 | 130, 134, 190, 225, 229 and 258 |
| 130, 134, 190, 225, 229 and 289 | 130, 134, 190, 225, 229 and 303 | 130, 134, 190, 225, 229 and 336 | 130, 134, 190, 225, 258 and 289 | 130, 134, 190, 225, 258 and 303 |
| 130, 134, 190, 225, 258 and 336 | 130, 134, 190, 225, 289 and 303 | 130, 134, 190, 225, 289 and 336 | 130, 134, 190, 225, 303 and 336 | 130, 134, 190, 229, 258 and 289 |
| 130, 134, 190, 229, 258 and 303 | 130, 134, 190, 229, 258 and 336 | 130, 134, 190, 229, 289 and 303 | 130, 134, 190, 229, 289 and 336 | 130, 134, 190, 229, 303 and 336 |
| 130, 134, 190, 258, 289 and 303 | 130, 134, 190, 258, 289 and 336 | 130, 134, 190, 258, 303 and 336 | 130, 134, 190, 289, 303 and 336 | 130, 134, 225, 229, 258 and 289 |
| 130, 134, 225, 229, 258 and 303 | 130, 134, 225, 229, 258 and 336 | 130, 134, 225, 229, 289 and 303 | 130, 134, 225, 229, 289 and 336 | 130, 134, 225, 229, 303 and 336 |
| 130, 134, 225, 258, 289 and 303 | 130, 134, 225, 258, 289 and 336 | 130, 134, 225, 258, 303 and 336 | 130, 134, 225, 289, 303 and 336 | 130, 134, 229, 258, 289 and 303 |
| 130, 134, 229, 258, 289 and 336 | 130, 134, 229, 258, 303 and 336 | 130, 134, 229, 289, 303 and 336 | 130, 134, 258, 289, 303 and 336 | 130, 154, 190, 225, 229 and 258 |
| 130, 154, 190, 225, 229 and 289 | 130, 154, 190, 225, 229 and 303 | 130, 154, 190, 225, 229 and 336 | 130, 154, 190, 225, 258 and 289 | 130, 154, 190, 225, 258 and 303 |
| 130, 154, 190, 225, 258 and 336 | 130, 154, 190, 225, 289 and 303 | 130, 154, 190, 225, 289 and 336 | 130, 154, 190, 225, 303 and 336 | 130, 154, 190, 229, 258 and 289 |
| 130, 154, 190, 229, 258 and 303 | 130, 154, 190, 229, 258 and 336 | 130, 154, 190, 229, 289 and 303 | 130, 154, 190, 229, 289 and 336 | 130, 154, 190, 229, 303 and 336 |

TABLE 20-continued

| Non-limiting examples of positions that may comprise a mutation, or a set of mutations [as compared to SEQ ID NO: 35] | | | | |
|---|---|---|---|---|
| 130, 154, 190, 258, 289 and 303 | 130, 154, 190, 258, 289 and 336 | 130, 154, 190, 258, 303 and 336 | 130, 154, 190, 289, 303 and 336 | 130, 154, 225, 229, 258 and 289 |
| 130, 154, 225, 229, 258 and 303 | 130, 154, 225, 229, 258 and 336 | 130, 154, 225, 229, 289 and 303 | 130, 154, 225, 229, 289 and 336 | 130, 154, 225, 229, 303 and 336 |
| 130, 154, 225, 258, 289 and 303 | 130, 154, 225, 258, 289 and 336 | 130, 154, 225, 258, 303 and 336 | 130, 154, 225, 289, 303 and 336 | 130, 154, 229, 258, 289 and 303 |
| 130, 154, 229, 258, 289 and 336 | 130, 154, 229, 258, 303 and 336 | 130, 154, 229, 289, 303 and 336 | 130, 154, 258, 289, 303 and 336 | 130, 190, 225, 229, 258 and 289 |
| 130, 190, 225, 229, 258 and 303 | 130, 190, 225, 229, 258 and 336 | 130, 190, 225, 229, 289 and 303 | 130, 190, 225, 229, 289 and 336 | 130, 190, 225, 229, 303 and 336 |
| 130, 190, 225, 258, 289 and 303 | 130, 190, 225, 258, 289 and 336 | 130, 190, 225, 258, 303 and 336 | 130, 190, 225, 289, 303 and 336 | 130, 190, 229, 258, 289 and 303 |
| 130, 190, 229, 258, 289 and 336 | 130, 190, 229, 258, 303 and 336 | 130, 190, 229, 289, 303 and 336 | 130, 190, 258, 289, 303 and 336 | 130, 225, 229, 258, 289 and 303 |
| 130, 225, 229, 258, 289 and 336 | 130, 225, 229, 258, 303 and 336 | 130, 225, 229, 289, 303 and 336 | 130, 225, 258, 289, 303 and 336 | 130, 229, 258, 289, 303 and 336 |
| 134, 154, 190, 225, 229 and 258 | 134, 154, 190, 225, 229 and 289 | 134, 154, 190, 225, 229 and 303 | 134, 154, 190, 225, 229 and 336 | 134, 154, 190, 225, 258 and 289 |
| 134, 154, 190, 225, 258 and 303 | 134, 154, 190, 225, 258 and 336 | 134, 154, 190, 225, 289 and 303 | 134, 154, 190, 225, 289 and 336 | 134, 154, 190, 225, 303 and 336 |
| 134, 154, 190, 229, 258 and 289 | 134, 154, 190, 229, 258 and 303 | 134, 154, 190, 229, 258 and 336 | 134, 154, 190, 229, 289 and 303 | 134, 154, 190, 229, 289 and 336 |
| 134, 154, 190, 229, 303 and 336 | 134, 154, 190, 258, 289 and 303 | 134, 154, 190, 258, 289 and 336 | 134, 154, 190, 258, 303 and 336 | 134, 154, 190, 289, 303 and 336 |
| 134, 154, 225, 229, 258 and 289 | 134, 154, 225, 229, 258 and 303 | 134, 154, 225, 229, 258 and 336 | 134, 154, 225, 229, 289 and 303 | 134, 154, 225, 229, 289 and 336 |
| 134, 154, 225, 229, 303 and 336 | 134, 154, 225, 258, 289 and 303 | 134, 154, 225, 258, 289 and 336 | 134, 154, 225, 258, 303 and 336 | 134, 154, 225, 289, 303 and 336 |
| 134, 154, 229, 258, 289 and 303 | 134, 154, 229, 258, 289 and 336 | 134, 154, 229, 258, 303 and 336 | 134, 154, 229, 289, 303 and 336 | 134, 154, 258, 289, 303 and 336 |
| 134, 190, 225, 229, 258 and 289 | 134, 190, 225, 229, 258 and 303 | 134, 190, 225, 229, 258 and 336 | 134, 190, 225, 229, 289 and 303 | 134, 190, 225, 229, 289 and 336 |
| 134, 190, 225, 229, 303 and 336 | 134, 190, 225, 258, 289 and 303 | 134, 190, 225, 258, 289 and 336 | 134, 190, 225, 258, 303 and 336 | 134, 190, 225, 289, 303 and 336 |
| 134, 190, 229, 258, 289 and 303 | 134, 190, 229, 258, 289 and 336 | 134, 190, 229, 258, 303 and 336 | 134, 190, 229, 289, 303 and 336 | 134, 190, 258, 289, 303 and 336 |
| 134, 225, 229, 258, 289 and 303 | 134, 225, 229, 258, 289 and 336 | 134, 225, 229, 258, 303 and 336 | 134, 225, 229, 289, 303 and 336 | 134, 225, 258, 289, 303 and 336 |
| 134, 229, 258, 289, 303 and 336 | 154, 190, 225, 229, 258 and 289 | 154, 190, 225, 229, 258 and 303 | 154, 190, 225, 229, 258 and 336 | 154, 190, 225, 229, 289 and 303 |
| 154, 190, 225, 229, 289 and 336 | 154, 190, 225, 229, 303 and 336 | 154, 190, 225, 258, 289 and 303 | 154, 190, 225, 258, 289 and 336 | 154, 190, 225, 258, 303 and 336 |
| 154, 190, 225, 289, 303 and 336 | 154, 190, 229, 258, 289 and 303 | 154, 190, 229, 258, 289 and 336 | 154, 190, 229, 258, 303 and 336 | 154, 190, 229, 289, 303 and 336 |
| 154, 190, 258, 289, 303 and 336 | 154, 225, 229, 258, 289 and 303 | 154, 225, 229, 258, 289 and 336 | 154, 225, 229, 258, 303 and 336 | 154, 225, 229, 289, 303 and 336 |
| 154, 225, 258, 289, 303 and 336 | 154, 229, 258, 289, 303 and 336 | 190, 225, 229, 258, 289 and 303 | 190, 225, 229, 258, 289 and 336 | 190, 225, 229, 258, 303 and 336 |
| 190, 225, 229, 289, 303 and 336 | 190, 225, 258, 289, 303 and 336 | 190, 229, 258, 289, 303 and 336 | 225, 229, 258, 289, 303 and 336 | 85, 121, 130, 134, 154, 190 and 225 |
| 85, 121, 130, 134, 154, 190 and 229 | 85, 121, 130, 134, 154, 190 and 258 | 85, 121, 130, 134, 154, 190 and 289 | 85, 121, 130, 134, 154, 190 and 303 | 85, 121, 130, 134, 154, 190 and 336 |
| 85, 121, 130, 134, 154, 225 and 229 | 85, 121, 130, 134, 154, 225 and 258 | 85, 121, 130, 134, 154, 225 and 289 | 85, 121, 130, 134, 154, 225 and 303 | 85, 121, 130, 134, 154, 225 and 336 |
| 85, 121, 130, 134, 154, 229 and 258 | 85, 121, 130, 134, 154, 229 and 289 | 85, 121, 130, 134, 154, 229 and 303 | 85, 121, 130, 134, 154, 229 and 336 | 85, 121, 130, 134, 154, 258 and 289 |
| 85, 121, 130, 134, 154, 258 and 303 | 85, 121, 130, 134, 154, 258 and 336 | 85, 121, 130, 134, 154, 289 and 303 | 85, 121, 130, 134, 154, 289 and 336 | 85, 121, 130, 134, 154, 303 and 336 |
| 85, 121, 130, 134, 190, 225 and 229 | 85, 121, 130, 134, 190, 225 and 258 | 85, 121, 130, 134, 190, 225 and 289 | 85, 121, 130, 134, 190, 225 and 303 | 85, 121, 130, 134, 190, 225 and 336 |
| 85, 121, 130, 134, 190, 229 and 258 | 85, 121, 130, 134, 190, 229 and 289 | 85, 121, 130, 134, 190, 229 and 303 | 85, 121, 130, 134, 190, 229 and 336 | 85, 121, 130, 134, 190, 258 and 289 |
| 85, 121, 130, 134, 190, 258 and 303 | 85, 121, 130, 134, 190, 258 and 336 | 85, 121, 130, 134, 190, 289 and 303 | 85, 121, 130, 134, 190, 289 and 336 | 85, 121, 130, 134, 190, 303 and 336 |
| 85, 121, 130, 134, 225, 229 and 258 | 85, 121, 130, 134, 225, 229 and 289 | 85, 121, 130, 134, 225, 229 and 303 | 85, 121, 130, 134, 225, 229 and 336 | 85, 121, 130, 134, 225, 258 and 289 |
| 85, 121, 130, 134, 225, 258 and 303 | 85, 121, 130, 134, 225, 258 and 336 | 85, 121, 130, 134, 225, 289 and 303 | 85, 121, 130, 134, 225, 289 and 336 | 85, 121, 130, 134, 225, 303 and 336 |
| 85, 121, 130, 134, 229, 258 and 289 | 85, 121, 130, 134, 229, 258 and 303 | 85, 121, 130, 134, 229, 258 and 336 | 85, 121, 130, 134, 229, 289 and 303 | 85, 121, 130, 134, 229, 289 and 336 |
| 85, 121, 130, 134, 229, 303 and 336 | 85, 121, 130, 134, 258, 289 and 303 | 85, 121, 130, 134, 258, 289 and 336 | 85, 121, 130, 134, 258, 303 and 336 | 85, 121, 130, 134, 289, 303 and 336 |
| 85, 121, 130, 154, 190, 225 and 229 | 85, 121, 130, 154, 190, 225 and 258 | 85, 121, 130, 154, 190, 225 and 289 | 85, 121, 130, 154, 190, 225 and 303 | 85, 121, 130, 154, 190, 225 and 336 |
| 85, 121, 130, 154, 190, 229 and 258 | 85, 121, 130, 154, 190, 229 and 289 | 85, 121, 130, 154, 190, 229 and 303 | 85, 121, 130, 154, 190, 229 and 336 | 85, 121, 130, 154, 190, 258 and 289 |
| 85, 121, 130, 154, 190, 258 and 303 | 85, 121, 130, 154, 190, 258 and 336 | 85, 121, 130, 154, 190, 289 and 303 | 85, 121, 130, 154, 190, 289 and 336 | 85, 121, 130, 154, 190, 303 and 336 |

TABLE 20-continued

| Non-limiting examples of positions that may comprise a mutation, or a set of mutations [as compared to SEQ ID NO: 35] | | | | |
|---|---|---|---|---|
| 85, 121, 130, 154, 225, 229 and 258 | 85, 121, 130, 154, 225, 229 and 289 | 85, 121, 130, 154, 225, 229 and 303 | 85, 121, 130, 154, 225, 229 and 336 | 85, 121, 130, 154, 225, 258 and 289 |
| 85, 121, 130, 154, 225, 258 and 303 | 85, 121, 130, 154, 225, 258 and 336 | 85, 121, 130, 154, 225, 289 and 303 | 85, 121, 130, 154, 225, 289 and 336 | 85, 121, 130, 154, 225, 303 and 336 |
| 85, 121, 130, 154, 229, 258 and 289 | 85, 121, 130, 154, 229, 258 and 303 | 85, 121, 130, 154, 229, 258 and 336 | 85, 121, 130, 154, 229, 289 and 303 | 85, 121, 130, 154, 229, 289 and 336 |
| 85, 121, 130, 154, 229, 303 and 336 | 85, 121, 130, 154, 258, 289 and 303 | 85, 121, 130, 154, 258, 289 and 336 | 85, 121, 130, 154, 258, 303 and 336 | 85, 121, 130, 154, 289, 303 and 336 |
| 85, 121, 130, 190, 225, 229 and 258 | 85, 121, 130, 190, 225, 229 and 289 | 85, 121, 130, 190, 225, 229 and 303 | 85, 121, 130, 190, 225, 229 and 336 | 85, 121, 130, 190, 225, 258 and 289 |
| 85, 121, 130, 190, 225, 258 and 303 | 85, 121, 130, 190, 225, 258 and 336 | 85, 121, 130, 190, 225, 289 and 303 | 85, 121, 130, 190, 225, 289 and 336 | 85, 121, 130, 190, 225, 303 and 336 |
| 85, 121, 130, 190, 229, 258 and 289 | 85, 121, 130, 190, 229, 258 and 303 | 85, 121, 130, 190, 229, 258 and 336 | 85, 121, 130, 190, 229, 289 and 303 | 85, 121, 130, 190, 229, 289 and 336 |
| 85, 121, 130, 190, 229, 303 and 336 | 85, 121, 130, 190, 258, 289 and 303 | 85, 121, 130, 190, 258, 289 and 336 | 85, 121, 130, 190, 258, 303 and 336 | 85, 121, 130, 190, 289, 303 and 336 |
| 85, 121, 130, 225, 229, 258 and 289 | 85, 121, 130, 225, 229, 258 and 303 | 85, 121, 130, 225, 229, 258 and 336 | 85, 121, 130, 225, 229, 289 and 303 | 85, 121, 130, 225, 229, 289 and 336 |
| 85, 121, 130, 225, 229, 303 and 336 | 85, 121, 130, 225, 258, 289 and 303 | 85, 121, 130, 225, 258, 289 and 336 | 85, 121, 130, 225, 258, 303 and 336 | 85, 121, 130, 225, 289, 303 and 336 |
| 85, 121, 130, 229, 258, 289 and 303 | 85, 121, 130, 229, 258, 289 and 336 | 85, 121, 130, 229, 258, 303 and 336 | 85, 121, 130, 229, 289, 303 and 336 | 85, 121, 130, 258, 289, 303 and 336 |
| 85, 121, 134, 154, 190, 225 and 229 | 85, 121, 134, 154, 190, 225 and 258 | 85, 121, 134, 154, 190, 225 and 289 | 85, 121, 134, 154, 190, 225 and 303 | 85, 121, 134, 154, 190, 225 and 336 |
| 85, 121, 134, 154, 190, 229 and 258 | 85, 121, 134, 154, 190, 229 and 289 | 85, 121, 134, 154, 190, 229 and 303 | 85, 121, 134, 154, 190, 229 and 336 | 85, 121, 134, 154, 190, 258 and 289 |
| 85, 121, 134, 154, 190, 258 and 303 | 85, 121, 134, 154, 190, 258 and 336 | 85, 121, 134, 154, 190, 289 and 303 | 85, 121, 134, 154, 190, 289 and 336 | 85, 121, 134, 154, 190, 303 and 336 |
| 85, 121, 134, 154, 225, 229 and 258 | 85, 121, 134, 154, 225, 229 and 289 | 85, 121, 134, 154, 225, 229 and 303 | 85, 121, 134, 154, 225, 229 and 336 | 85, 121, 134, 154, 225, 258 and 289 |
| 85, 121, 134, 154, 225, 258 and 303 | 85, 121, 134, 154, 225, 258 and 336 | 85, 121, 134, 154, 225, 289 and 303 | 85, 121, 134, 154, 225, 289 and 336 | 85, 121, 134, 154, 225, 303 and 336 |
| 85, 121, 134, 154, 229, 258 and 289 | 85, 121, 134, 154, 229, 258 and 303 | 85, 121, 134, 154, 229, 258 and 336 | 85, 121, 134, 154, 229, 289 and 303 | 85, 121, 134, 154, 229, 289 and 336 |
| 85, 121, 134, 154, 229, 303 and 336 | 85, 121, 134, 154, 258, 289 and 303 | 85, 121, 134, 154, 258, 289 and 336 | 85, 121, 134, 154, 258, 303 and 336 | 85, 121, 134, 154, 289, 303 and 336 |
| 85, 121, 134, 190, 225, 229 and 258 | 85, 121, 134, 190, 225, 229 and 289 | 85, 121, 134, 190, 225, 229 and 303 | 85, 121, 134, 190, 225, 229 and 336 | 85, 121, 134, 190, 225, 258 and 289 |
| 85, 121, 134, 190, 225, 258 and 303 | 85, 121, 134, 190, 225, 258 and 336 | 85, 121, 134, 190, 225, 289 and 303 | 85, 121, 134, 190, 225, 289 and 336 | 85, 121, 134, 190, 225, 303 and 336 |
| 85, 121, 134, 190, 229, 258 and 289 | 85, 121, 134, 190, 229, 258 and 303 | 85, 121, 134, 190, 229, 258 and 336 | 85, 121, 134, 190, 229, 289 and 303 | 85, 121, 134, 190, 229, 289 and 336 |
| 85, 121, 134, 190, 229, 303 and 336 | 85, 121, 134, 190, 258, 289 and 303 | 85, 121, 134, 190, 258, 289 and 336 | 85, 121, 134, 190, 258, 303 and 336 | 85, 121, 134, 190, 289, 303 and 336 |
| 85, 121, 134, 225, 229, 258 and 289 | 85, 121, 134, 225, 229, 258 and 303 | 85, 121, 134, 225, 229, 258 and 336 | 85, 121, 134, 225, 229, 289 and 303 | 85, 121, 134, 225, 229, 289 and 336 |
| 85, 121, 134, 225, 229, 303 and 336 | 85, 121, 134, 225, 258, 289 and 303 | 85, 121, 134, 225, 258, 289 and 336 | 85, 121, 134, 225, 258, 303 and 336 | 85, 121, 134, 225, 289, 303 and 336 |
| 85, 121, 134, 229, 258, 289 and 303 | 85, 121, 134, 229, 258, 289 and 336 | 85, 121, 134, 229, 258, 303 and 336 | 85, 121, 134, 229, 289, 303 and 336 | 85, 121, 134, 258, 289, 303 and 336 |
| 85, 121, 154, 190, 225, 229 and 258 | 85, 121, 154, 190, 225, 229 and 289 | 85, 121, 154, 190, 225, 229 and 303 | 85, 121, 154, 190, 225, 229 and 336 | 85, 121, 154, 190, 225, 258 and 289 |
| 85, 121, 154, 190, 225, 258 and 303 | 85, 121, 154, 190, 225, 258 and 336 | 85, 121, 154, 190, 225, 289 and 303 | 85, 121, 154, 190, 225, 289 and 336 | 85, 121, 154, 190, 225, 303 and 336 |
| 85, 121, 154, 190, 229, 258 and 289 | 85, 121, 154, 190, 229, 258 and 303 | 85, 121, 154, 190, 229, 258 and 336 | 85, 121, 154, 190, 229, 289 and 303 | 85, 121, 154, 190, 229, 289 and 336 |
| 85, 121, 154, 190, 229, 303 and 336 | 85, 121, 154, 190, 258, 289 and 303 | 85, 121, 154, 190, 258, 289 and 336 | 85, 121, 154, 190, 258, 303 and 336 | 85, 121, 154, 190, 289, 303 and 336 |
| 85, 121, 154, 225, 229, 258 and 289 | 85, 121, 154, 225, 229, 258 and 303 | 85, 121, 154, 225, 229, 258 and 336 | 85, 121, 154, 225, 229, 289 and 303 | 85, 121, 154, 225, 229, 289 and 336 |
| 85, 121, 154, 225, 229, 303 and 336 | 85, 121, 154, 225, 258, 289 and 303 | 85, 121, 154, 225, 258, 289 and 336 | 85, 121, 154, 225, 258, 303 and 336 | 85, 121, 154, 225, 289, 303 and 336 |
| 85, 121, 154, 229, 258, 289 and 303 | 85, 121, 154, 229, 258, 289 and 336 | 85, 121, 154, 229, 258, 303 and 336 | 85, 121, 154, 229, 289, 303 and 336 | 85, 121, 154, 258, 289, 303 and 336 |
| 85, 121, 190, 225, 229, 258 and 289 | 85, 121, 190, 225, 229, 258 and 303 | 85, 121, 190, 225, 229, 258 and 336 | 85, 121, 190, 225, 229, 289 and 303 | 85, 121, 190, 225, 229, 289 and 336 |
| 85, 121, 190, 225, 229, 303 and 336 | 85, 121, 190, 225, 258, 289 and 303 | 85, 121, 190, 225, 258, 289 and 336 | 85, 121, 190, 225, 258, 303 and 336 | 85, 121, 190, 225, 289, 303 and 336 |
| 85, 121, 190, 229, 258, 289 and 303 | 85, 121, 190, 229, 258, 289 and 336 | 85, 121, 190, 229, 258, 303 and 336 | 85, 121, 190, 229, 289, 303 and 336 | 85, 121, 190, 258, 289, 303 and 336 |
| 85, 121, 225, 229, 258, 289 and 303 | 85, 121, 225, 229, 258, 289 and 336 | 85, 121, 225, 229, 258, 303 and 336 | 85, 121, 225, 229, 289, 303 and 336 | 85, 121, 225, 258, 289, 303 and 336 |
| 85, 121, 229, 258, 289, 303 and 336 | 85, 130, 134, 154, 190, 225 and 229 | 85, 130, 134, 154, 190, 225 and 258 | 85, 130, 134, 154, 190, 225 and 289 | 85, 130, 134, 154, 190, 225 and 303 |
| 85, 130, 134, 154, 190, 225 and 336 | 85, 130, 134, 154, 190, 229 and 258 | 85, 130, 134, 154, 190, 229 and 289 | 85, 130, 134, 154, 190, 229 and 303 | 85, 130, 134, 154, 190, 229 and 336 |
| 85, 130, 134, 154, 190, 258 and 289 | 85, 130, 134, 154, 190, 258 and 303 | 85, 130, 134, 154, 190, 258 and 336 | 85, 130, 134, 154, 190, 289 and 303 | 85, 130, 134, 154, 190, 289 and 336 |

TABLE 20-continued

Non-limiting examples of positions that may comprise a mutation, or a set of mutations [as compared to SEQ ID NO: 35]

| | | | | |
|---|---|---|---|---|
| 85, 130, 134, 154, 190, 303 and 336 | 85, 130, 134, 154, 225, 229 and 258 | 85, 130, 134, 154, 225, 229 and 289 | 85, 130, 134, 154, 225, 229 and 303 | 85, 130, 134, 154, 225, 229 and 336 |
| 85, 130, 134, 154, 225, 258 and 289 | 85, 130, 134, 154, 225, 258 and 303 | 85, 130, 134, 154, 225, 258 and 336 | 85, 130, 134, 154, 225, 289 and 303 | 85, 130, 134, 154, 225,289 and 336 |
| 85, 130, 134, 154, 225, 303 and 336 | 85, 130, 134, 154, 229, 258 and 289 | 85, 130, 134, 154, 229, 258 and 303 | 85, 130, 134, 154, 229, 258 and 336 | 85, 130, 134, 154, 229,289 and 303 |
| 85, 130, 134, 154, 229, 289 and 336 | 85, 130, 134, 154, 229, 303 and 336 | 85, 130, 134, 154, 258, 289 and 303 | 85, 130, 134, 154, 258, 289 and 336 | 85, 130, 134, 154, 258,303 and 336 |
| 85, 130, 134, 154, 289, 303 and 336 | 85, 130, 134, 190, 225, 229 and 258 | 85, 130, 134, 190, 225, 229 and 289 | 85, 130, 134, 190, 225, 229 and 303 | 85, 130, 134, 190, 225,229 and 336 |
| 85, 130, 134, 190, 225, 258 and 289 | 85, 130, 134, 190, 225, 258 and 303 | 85, 130, 134, 190, 225, 258 and 336 | 85, 130, 134, 190, 225, 289 and 303 | 85, 130, 134, 190, 225,289 and 336 |
| 85, 130, 134, 190, 225, 303 and 336 | 85, 130, 134, 190, 229, 258 and 289 | 85, 130, 134, 190, 229, 258 and 303 | 85, 130, 134, 190, 229, 258 and 336 | 85, 130, 134, 190, 229,289 and 303 |
| 85, 130, 134, 190, 229, 289 and 336 | 85, 130, 134, 190, 229, 303 and 336 | 85, 130, 134, 190, 258, 289 and 303 | 85, 130, 134, 190, 258, 289 and 336 | 85, 130, 134, 190, 258,303 and 336 |
| 85, 130, 134, 190, 289, 303 and 336 | 85, 130, 134, 225, 229, 258 and 289 | 85, 130, 134, 225, 229, 258 and 303 | 85, 130, 134, 225, 229, 258 and 336 | 85, 130, 134, 225, 229,289 and 303 |
| 85, 130, 134, 225, 229, 289 and 336 | 85, 130, 134, 225, 229, 303 and 336 | 85, 130, 134, 225, 258, 289 and 303 | 85, 130, 134, 225, 258, 289 and 336 | 85, 130, 134, 225, 258,303 and 336 |
| 85, 130, 134, 225, 289, 303 and 336 | 85, 130, 134, 229, 258, 289 and 303 | 85, 130, 134, 229, 258, 289 and 336 | 85, 130, 134, 229, 258, 303 and 336 | 85, 130, 134, 229, 289, 303 and 336 |
| 85, 130, 134, 258, 289, 303 and 336 | 85, 130, 154, 190, 225, 229 and 258 | 85, 130, 154, 190, 225, 229 and 289 | 85, 130, 154, 190, 225, 229 and 303 | 85, 130, 154, 190, 225, 229 and 336 |
| 85, 130, 154, 190, 225, 258 and 289 | 85, 130, 154, 190, 225, 258 and 303 | 85, 130, 154, 190, 225, 258 and 336 | 85, 130, 154, 190, 225, 289 and 303 | 85, 130, 154, 190, 225, 289 and 336 |
| 85, 130, 154, 190, 225, 303 and 336 | 85, 130, 154, 190, 229, 258 and 289 | 85, 130, 154, 190, 229, 258 and 303 | 85, 130, 154, 190, 229, 258 and 336 | 85, 130, 154, 190, 229, 289 and 303 |
| 85, 130, 154, 190, 229, 289 and 336 | 85, 130, 154, 190, 229, 303 and 336 | 85, 130, 154, 190, 258, 289 and 303 | 85, 130, 154, 190, 258, 289 and 336 | 85, 130, 154, 190, 258, 303 and 336 |
| 85, 130, 154, 190, 289, 303 and 336 | 85, 130, 154, 225, 229, 258 and 289 | 85, 130, 154, 225, 229, 258 and 303 | 85, 130, 154, 225, 229, 258 and 336 | 85, 130, 154, 225, 229, 289 and 303 |
| 85, 130, 154, 225, 229, 289 and 336 | 85, 130, 154, 225, 229, 303 and 336 | 85, 130, 154, 225, 258, 289 and 303 | 85, 130, 154, 225, 258, 289 and 336 | 85, 130, 154, 225, 258, 303 and 336 |
| 85, 130, 154, 225, 289, 303 and 336 | 85, 130, 154, 229, 258, 289 and 303 | 85, 130, 154, 229, 258, 289 and 336 | 85, 130, 154, 229, 258, 303 and 336 | 85, 130, 154, 229, 289, 303 and 336 |
| 85, 130, 154, 258, 289, 303 and 336 | 85, 130, 190, 225, 229, 258 and 289 | 85, 130, 190, 225, 229, 258 and 303 | 85, 130, 190, 225, 229, 258 and 336 | 85, 130, 190, 225, 229, 289 and 303 |
| 85, 130, 190, 225, 229, 289 and 336 | 85, 130, 190, 225, 229, 303 and 336 | 85, 130, 190, 225, 258, 289 and 303 | 85, 130, 190, 225, 258, 289 and 336 | 85, 130, 190, 225, 258, 303 and 336 |
| 85, 130, 190, 225, 289, 303 and 336 | 85, 130, 190, 229, 258, 289 and 303 | 85, 130, 190, 229, 258, 289and 336 | 85, 130, 190, 229, 258, 303 and 336 | 85, 130, 190, 229, 289, 303 and 336 |
| 85, 130, 190, 258, 289, 303 and 336 | 85, 130, 225, 229, 258, 289 and 303 | 85, 130, 225, 229, 258, 289 and 336 | 85, 130, 225, 229, 258, 303 and 336 | 85, 130, 225, 229, 289, 303 and 336 |
| 85, 130, 225, 258, 289, 303 and 336 | 85, 130, 229, 258, 289, 303 and 336 | 85, 134, 154, 190, 225, 229 and 258 | 85, 134, 154, 190, 225, 229 and 289 | 85, 134, 154, 190, 225, 229 and 303 |
| 85, 134, 154, 190, 225, 229 and 336 | 85, 134, 154, 190, 225, 258 and 289 | 85, 134, 154, 190, 225, 258 and 303 | 85, 134, 154, 190, 225, 258 and 336 | 85, 134, 154, 190, 225, 289 and 303 |
| 85, 134, 154, 190, 225, 289 and 336 | 85, 134, 154, 190, 225, 303 and 336 | 85, 134, 154, 190, 229, 258 and 289 | 85, 134, 154, 190, 229, 258 and 303 | 85, 134, 154, 190, 229, 258 and 336 |
| 85, 134, 154, 190, 229, 289 and 303 | 85, 134, 154, 190, 229, 289 and 336 | 85, 134, 154, 190, 229, 303 and 336 | 85, 134, 154, 190, 258, 289 and 303 | 85, 134, 154, 190, 258, 289 and 336 |
| 85, 134, 154, 190, 258, 303 and 336 | 85, 134, 154, 190, 289, 303 and 336 | 85, 134, 154, 225, 229, 258 and 289 | 85, 134, 154, 225, 229, 258 and 303 | 85, 134, 154, 225, 229, 258 and 336 |
| 85, 134, 154, 225, 229, 289 and 303 | 85, 134, 154, 225, 229, 289 and 336 | 85, 134, 154, 225, 229, 303 and 336 | 85, 134, 154, 225, 258, 289 and 303 | 85, 134, 154, 225, 258, 289 and 336 |
| 85, 134, 154, 225, 258, 303 and 336 | 85, 134, 154, 225, 289, 303 and 336 | 85, 134, 154, 229, 258, 289 and 303 | 85, 134, 154, 229, 258, 289 and 336 | 85, 134, 154, 229, 258, 303 and 336 |
| 85, 134, 154, 229, 289, 303 and 336 | 85, 134, 154, 258, 289, 303 and 336 | 85, 134, 190, 225, 229, 258 and 289 | 85, 134, 190, 225, 229, 258 and 303 | 85, 134, 190, 225, 229, 258 and 336 |
| 85, 134, 190, 225, 229, 289 and 303 | 85, 134, 190, 225, 229, 289 and 336 | 85, 134, 190, 225, 229, 303 and 336 | 85, 134, 190, 225, 258, 289 and 303 | 85, 134, 190, 225, 258, 289 and 336 |
| 85, 134, 190, 225, 258, 303 and 336 | 85, 134, 190, 225, 289, 303 and 336 | 85, 134, 190, 229, 258, 289 and 303 | 85, 134, 190, 229, 258, 289 and 336 | 85, 134, 190, 229, 258, 303 and 336 |
| 85, 134, 190, 229, 289, 303 and 336 | 85, 134, 190, 258, 289, 303 and 336 | 85, 134, 225, 229, 258, 289 and 303 | 85, 134, 225, 229, 258, 289 and 336 | 85, 134, 225, 229, 258, 303 and 336 |
| 85, 134, 225, 229, 289, 303 and 336 | 85, 134, 225, 258, 289, 303 and 336 | 85, 134, 229, 258, 289, 303 and 336 | 85, 154, 190, 225, 229, 258 and 289 | 85, 154, 190, 225, 229, 258 and 303 |
| 85, 154, 190, 225, 229, 258 and 336 | 85, 154, 190, 225, 229, 289 and 303 | 85, 154, 190, 225, 229, 289 and 336 | 85, 154, 190, 225, 229, 303 and 336 | 85, 154, 190, 225, 258, 289 and 303 |
| 85, 154, 190, 225, 258, 289 and 336 | 85, 154, 190, 225, 258, 303 and 336 | 85, 154, 190, 225, 289, 303 and 336 | 85, 154, 190, 229, 258, 289 and 303 | 85, 154, 190, 229, 258, 289 and 336 |
| 85, 154, 190, 229, 258, 303 and 336 | 85, 154, 190, 229, 289, 303 and 336 | 85, 154, 190, 258, 289, 303 and 336 | 85, 154, 225, 229, 258, 289 and 303 | 85, 154, 225, 229, 258, 289 and 336 |
| 85, 154, 225, 229, 258, 303 and 336 | 85, 154, 225, 229, 289, 303 and 336 | 85, 154, 225, 258, 289, 303 and 336 | 85, 154, 229, 258, 289, 303 and 336 | 85, 190, 225, 229, 258, 289 and 303 |
| 85, 190, 225, 229, 258, 289 and 336 | 85, 190, 225, 229, 258, 303 and 336 | 85, 190, 225, 229, 289, 303 and 336 | 85, 190, 225, 258, 289, 303 and 336 | 85, 190, 229, 258, 289, 303 and 336 |

TABLE 20-continued

Non-limiting examples of positions that may comprise a mutation, or a set of mutations [as compared to SEQ ID NO: 35]

| | | | | |
|---|---|---|---|---|
| 85, 225, 229, 258, 289, 303 and 336 | 121, 130, 134, 154, 190, 225 and 229 | 121, 130, 134, 154, 190, 225 and 258 | 121, 130, 134, 154, 190, 225 and 289 | 121, 130, 134, 154, 190, 225 and 303 |
| 121, 130, 134, 154, 190, 225 and 336 | 121, 130, 134, 154, 190, 229 and 258 | 121, 130, 134, 154, 190, 229 and 289 | 121, 130, 134, 154, 190, 229 and 303 | 121, 130, 134, 154, 190, 229 and 336 |
| 121, 130, 134, 154, 190, 258 and 289 | 121, 130, 134, 154, 190, 258 and 303 | 121, 130, 134, 154, 190, 258 and 336 | 121, 130, 134, 154, 190, 289 and 303 | 121, 130, 134, 154, 190, 289 and 336 |
| 121, 130, 134, 154, 190, 303 and 336 | 121, 130, 134, 154, 225, 229 and 258 | 121, 130, 134, 154, 225, 229 and 289 | 121, 130, 134, 154, 225, 229 and 303 | 121, 130, 134, 154, 225, 229 and 336 |
| 121, 130, 134, 154, 225, 258 and 289 | 121, 130, 134, 154, 225, 258 and 303 | 121, 130, 134, 154, 225, 258 and 336 | 121, 130, 134, 154, 225, 289 and 303 | 121, 130, 134, 154, 225, 289 and 336 |
| 121, 130, 134, 154, 225, 303 and 336 | 121, 130, 134, 154, 229, 258 and 289 | 121, 130, 134, 154, 229, 258 and 303 | 121, 130, 134, 154, 229, 258 and 336 | 121, 130, 134, 154, 229, 289 and 303 |
| 121, 130, 134, 154, 229, 289 and 336 | 121, 130, 134, 154, 229, 303 and 336 | 121, 130, 134, 154, 258, 289 and 303 | 121, 130, 134, 154, 258, 289 and 336 | 121, 130, 134, 154, 258, 303 and 336 |
| 121, 130, 134, 154, 289, 303 and 336 | 121, 130, 134, 190, 225, 229 and 258 | 121, 130, 134, 190, 225, 229 and 289 | 121, 130, 134, 190, 225, 229 and 303 | 121, 130, 134, 190, 225, 229 and 336 |
| 121, 130, 134, 190, 225, 258 and 289 | 121, 130, 134, 190, 225, 258 and 303 | 121, 130, 134, 190, 225, 258 and 336 | 121, 130, 134, 190, 225, 289 and 303 | 121, 130, 134, 190, 225, 289 and 336 |
| 121, 130, 134, 190, 225, 303 and 336 | 121, 130, 134, 190, 229, 258 and 289 | 121, 130, 134, 190, 229, 258 and 303 | 121, 130, 134, 190, 229, 258 and 336 | 121, 130, 134, 190, 229, 289 and 303 |
| 121, 130, 134, 190, 229, 289 and 336 | 121, 130, 134, 190, 229, 303 and 336 | 121, 130, 134, 190, 258, 289 and 303 | 121, 130, 134, 190, 258, 289 and 336 | 121, 130, 134, 190, 258, 303 and 336 |
| 121, 130, 134, 190, 289, 303 and 336 | 121, 130, 134, 225, 229, 258 and 289 | 121, 130, 134, 225, 229, 258 and 303 | 121, 130, 134, 225, 229, 258 and 336 | 121, 130, 134, 225, 229, 289 and 303 |
| 121, 130, 134, 225, 229, 289 and 336 | 121, 130, 134, 225, 229, 303 and 336 | 121, 130, 134, 225, 258, 289 and 303 | 121, 130, 134, 225, 258, 289 and 336 | 121, 130, 134, 225, 258, 303 and 336 |
| 121, 130, 134, 225, 289, 303 and 336 | 121, 130, 134, 229, 258, 289 and 303 | 121, 130, 134, 229, 258, 289 and 336 | 121, 130, 134, 229, 258, 303 and 336 | 121, 130, 134, 229, 289, 303 and 336 |
| 121, 130, 134, 258, 289, 303 and 336 | 121, 130, 154, 190, 225, 229 and 258 | 121, 130, 154, 190, 225, 229 and 289 | 121, 130, 154, 190, 225, 229 and 303 | 121, 130, 154, 190, 225, 229 and 336 |
| 121, 130, 154, 190, 225, 258 and 289 | 121, 130, 154, 190, 225, 258 and 303 | 121, 130, 154, 190, 225, 258 and 336 | 121, 130, 154, 190, 225, 289 and 303 | 121, 130, 154, 190, 225, 289 and 336 |
| 121, 130, 154, 190, 225, 303 and 336 | 121, 130, 154, 190, 229, 258 and 289 | 121, 130, 154, 190, 229, 258 and 303 | 121, 130, 154, 190, 229, 258 and 336 | 121, 130, 154, 190, 229, 289 and 303 |
| 121, 130, 154, 190, 229, 289 and 336 | 121, 130, 154, 190, 229, 303 and 336 | 121, 130, 154, 190, 258, 289 and 303 | 121, 130, 154, 190, 258, 289 and 336 | 121, 130, 154, 190, 258, 303 and 336 |
| 121, 130, 154, 190, 289, 303 and 336 | 121, 130, 154, 225, 229, 258 and 289 | 121, 130, 154, 225, 229, 258 and 303 | 121, 130, 154, 225, 229, 258 and 336 | 121, 130, 154, 225, 229, 289 and 303 |
| 121, 130, 154, 225, 229, 289 and 336 | 121, 130, 154, 225, 229, 303 and 336 | 121, 130, 154, 225, 258, 289 and 303 | 121, 130, 154, 225, 258, 289 and 336 | 121, 130, 154, 225, 258, 303 and 336 |
| 121, 130, 154, 225, 289, 303 and 336 | 121, 130, 154, 229, 258, 289 and 303 | 121, 130, 154, 229, 258, 289 and 336 | 121, 130, 154, 229, 258, 303 and 336 | 121, 130, 154, 229, 289, 303 and 336 |
| 121, 130, 154, 258, 289, 303 and 336 | 121, 130, 190, 225, 229, 258 and 289 | 121, 130, 190, 225, 229, 258 and 303 | 121, 130, 190, 225, 229, 258 and 336 | 121, 130, 190, 225, 229, 289 and 303 |
| 121, 130, 190, 225, 229, 289 and 336 | 121, 130, 190, 225, 229, 303 and 336 | 121, 130, 190, 225, 258, 289 and 303 | 121, 130, 190, 225, 258, 289 and 336 | 121, 130, 190, 225, 258, 303 and 336 |
| 121, 130, 190, 225, 289, 303 and 336 | 121, 130, 190, 229, 258, 289 and 303 | 121, 130, 190, 229, 258, 289 and 336 | 121, 130, 190, 229, 258, 303 and 336 | 121, 130, 190, 229, 289, 303 and 336 |
| 121, 130, 190, 258, 289, 303 and 336 | 121, 130, 225, 229, 258, 289 and 303 | 121, 130, 225, 229, 258, 289 and 336 | 121, 130, 225, 229, 258, 303 and 336 | 121, 130, 225, 229, 289, 303 and 336 |
| 121, 130, 225, 258, 289, 303 and 336 | 121, 130, 229, 258, 289, 303 and 336 | 121, 134, 154, 190, 225, 229 and 258 | 121, 134, 154, 190, 225, 229 and 289 | 121, 134, 154, 190, 225, 229 and 303 |
| 121, 134, 154, 190, 225, 229 and 336 | 121, 134, 154, 190, 225, 258 and 289 | 121, 134, 154, 190, 225, 258 and 303 | 121, 134, 154, 190, 225, 258 and 336 | 121, 134, 154, 190, 225, 289 and 303 |
| 121, 134, 154, 190, 225, 289 and 336 | 121, 134, 154, 190, 225, 303 and 336 | 121, 134, 154, 190, 229, 258 and 289 | 121, 134, 154, 190, 229, 258 and 303 | 121, 134, 154, 190, 229, 258 and 336 |
| 121, 134, 154, 190, 229, 289 and 303 | 121, 134, 154, 190, 229, 289 and 336 | 121, 134, 154, 190, 229, 303 and 336 | 121, 134, 154, 190, 258, 289 and 303 | 121, 134, 154, 190, 258, 289 and 336 |
| 121, 134, 154, 190, 258, 303 and 336 | 121, 134, 154, 190, 289, 303 and 336 | 121, 134, 154, 225, 229, 258 and 289 | 121, 134, 154, 225, 229, 258 and 303 | 121, 134, 154, 225, 229, 258 and 336 |
| 121, 134, 154, 225, 229, 289 and 303 | 121, 134, 154, 225, 229, 289 and 336 | 121, 134, 154, 225, 229, 303 and 336 | 121, 134, 154, 225, 258, 289 and 303 | 121, 134, 154, 225, 258, 289 and 336 |
| 121, 134, 154, 225, 258, 303 and 336 | 121, 134, 154, 225, 289, 303 and 336 | 121, 134, 154, 229, 258, 289 and 303 | 121, 134, 154, 229, 258, 289 and 336 | 121, 134, 154, 229, 258, 303 and 336 |
| 121, 134, 154, 229, 258, 289 and 336 | 121, 134, 154, 258, 289, 303 and 336 | 121, 134, 190, 225, 229, 258 and 289 | 121, 134, 190, 225, 229, 258 and 303 | 121, 134, 190, 225, 229, 258 and 336 |
| 121, 134, 190, 225, 229, 289 and 303 | 121, 134, 190, 225, 229, 289 and 336 | 121, 134, 190, 225, 229, 303 and 336 | 121, 134, 190, 225, 258, 289 and 303 | 121, 134, 190, 225, 258, 289 and 336 |
| 121, 134, 190, 225, 258, 303 and 336 | 121, 134, 190, 225, 289, 303 and 336 | 121, 134, 190, 229, 258, 289 and 303 | 121, 134, 190, 229, 258, 289 and 336 | 121, 134, 190, 229, 258, 303 and 336 |
| 121, 134, 190, 229, 289, 303 and 336 | 121, 134, 190, 258, 289, 303 and 336 | 121, 134, 225, 229, 258, 289 and 303 | 121, 134, 225, 229, 258, 289 and 336 | 121, 134, 225, 229, 258, 303 and 336 |
| 121, 134, 225, 229, 289, 303 and 336 | 121, 134, 225, 258, 289, 303 and 336 | 121, 134, 229, 258, 289, 303 and 336 | 121, 154, 190, 225, 229, 258 and 289 | 121, 154, 190, 225, 229, 258 and 303 |
| 121, 154, 190, 225, 229, 258 and 336 | 121, 154, 190, 225, 229, 289 and 303 | 121, 154, 190, 225, 229, 289 and 336 | 121, 154, 190, 225, 229, 303 and 336 | 121, 154, 190, 225, 258, 289 and 303 |
| 121, 154, 190, 225, 258, 289 and 336 | 121, 154, 190, 225, 258, 303 and 336 | 121, 154, 190, 225, 289, 303 and 336 | 121, 154, 190, 229, 258, 289 and 303 | 121, 154, 190, 229, 258, 289 and 336 |

TABLE 20-continued

| Non-limiting examples of positions that may comprise a mutation, or a set of mutations [as compared to SEQ ID NO: 35] | | | | |
|---|---|---|---|---|
| 121, 154, 190, 229, 258, 303 and 336 | 121, 154, 190, 229, 289, 303 and 336 | 121, 154, 190, 258, 289, 303 and 336 | 121, 154, 225, 229, 258, 289 and 303 | 121, 154, 225, 229, 258, 289 and 336 |
| 121, 154, 225, 229, 258, 303 and 336 | 121, 154, 225, 229, 289, 303 and 336 | 121, 154, 225, 258, 289, 303 and 336 | 121, 154, 229, 258, 289, 303 and 336 | 121, 190, 225, 229, 258, 289 and 303 |
| 121, 190, 225, 229, 258, 289 and 336 | 121, 190, 225, 229, 258, 303 and 336 | 121, 190, 225, 229, 289, 303 and 336 | 121, 190, 225, 258, 289, 303 and 336 | 121, 190, 229, 258, 289, 303 and 336 |
| 121, 225, 229, 258, 289, 303 and 336 | 130, 134, 154, 190, 225, 229 and 258 | 130, 134, 154, 190, 225, 229 and 289 | 130, 134, 154, 190, 225, 229 and 303 | 130, 134, 154, 190, 225, 229 and 336 |
| 130, 134, 154, 190, 225, 258 and 289 | 130, 134, 154, 190, 225, 258 and 303 | 130, 134, 154, 190, 225, 258 and 336 | 130, 134, 154, 190, 225, 289 and 303 | 130, 134, 154, 190, 225, 289 and 336 |
| 130, 134, 154, 190, 225, 303 and 336 | 130, 134, 154, 190, 229, 258 and 289 | 130, 134, 154, 190, 229, 258 and 303 | 130, 134, 154, 190, 229, 258 and 336 | 130, 134, 154, 190, 229, 289 and 303 |
| 130, 134, 154, 190, 229, 289 and 336 | 130, 134, 154, 190, 229, 303 and 336 | 130, 134, 154, 190, 258, 289 and 303 | 130, 134, 154, 190, 258, 289 and 336 | 130, 134, 154, 190, 258, 303 and 336 |
| 130, 134, 154, 190, 289, 303 and 336 | 130, 134, 154, 225, 229, 258 and 289 | 130, 134, 154, 225, 229, 258 and 303 | 130, 134, 154, 225, 229, 258 and 336 | 130, 134, 154, 225, 229, 289 and 303 |
| 130, 134, 154, 225, 229, 289 and 336 | 130, 134, 154, 225, 229, 303 and 336 | 130, 134, 154, 225, 258, 289 and 303 | 130, 134, 154, 225, 258, 289 and 336 | 130, 134, 154, 225, 258, 303 and 336 |
| 130, 134, 154, 225, 289, 303 and 336 | 130, 134, 154, 229, 258, 289 and 303 | 130, 134, 154, 229, 258, 289 and 336 | 130, 134, 154, 229, 258, 303 and 336 | 130, 134, 154, 229, 289, 303 and 336 |
| 130, 134, 154, 258, 289, 303 and 336 | 130, 134, 190, 225, 229, 258 and 289 | 130, 134, 190, 225, 229, 258 and 303 | 130, 134, 190, 225, 229, 258 and 336 | 130, 134, 190, 225, 229, 289 and 303 |
| 130, 134, 190, 225, 229, 289 and 336 | 130, 134, 190, 225, 229, 303 and 336 | 130, 134, 190, 225, 258, 289 and 303 | 130, 134, 190, 225, 258, 289 and 336 | 130, 134, 190, 225, 258, 303 and 336 |
| 130, 134, 190, 225, 289, 303 and 336 | 130, 134, 190, 229, 258, 289 and 303 | 130, 134, 190, 229, 258, 289 and 336 | 130, 134, 190, 229, 258, 303 and 336 | 130, 134, 190, 229, 289, 303 and 336 |
| 130, 134, 190, 258, 289, 303 and 336 | 130, 134, 225, 229, 258, 289 and 303 | 130, 134, 225, 229, 258, 289 and 336 | 130, 134, 225, 229, 258, 303 and 336 | 130, 134, 225, 229, 289, 303 and 336 |
| 130, 134, 225, 258, 289, 303 and 336 | 130, 134, 229, 258, 289, 303 and 336 | 130, 154, 190, 225, 229, 258 and 289 | 130, 154, 190, 225, 229, 258 and 303 | 130, 154, 190, 225, 229, 258 and 336 |
| 130, 154, 190, 225, 229, 289 and 303 | 130, 154, 190, 225, 229, 289 and 336 | 130, 154, 190, 225, 229, 303 and 336 | 130, 154, 190, 225, 258, 289 and 303 | 130, 154, 190, 225, 258, 289 and 336 |
| 130, 154, 190, 225, 258, 303 and 336 | 130, 154, 190, 225, 289, 303 and 336 | 130, 154, 190, 229, 258, 289 and 303 | 130, 154, 190, 229, 258, 289 and 336 | 130, 154, 190, 229, 258, 303 and 336 |
| 130, 154, 190, 229, 289, 303 and 336 | 130, 154, 190, 258, 289, 303 and 336 | 130, 154, 225, 229, 258, 289 and 303 | 130, 154, 225, 229, 258, 289 and 336 | 130, 154, 225, 229, 258, 303 and 336 |
| 130, 154, 225, 229, 289, 303 and 336 | 130, 154, 225, 258, 289, 303 and 336 | 130, 154, 229, 258, 289, 303 and 336 | 130, 190, 225, 229, 258, 289 and 303 | 130, 190, 225, 229, 258, 289 and 336 |
| 130, 190, 225, 229, 258, 303 and 336 | 130, 190, 225, 229, 289, 303 and 336 | 130, 190, 225, 258, 289, 303 and 336 | 130, 190, 229, 258, 289, 303 and 336 | 130, 225, 229, 258, 289, 303 and 336 |
| 134, 154, 190, 225, 229, 258 and 289 | 134, 154, 190, 225, 229, 258 and 303 | 134, 154, 190, 225, 229, 258 and 336 | 134, 154, 190, 225, 229, 289 and 303 | 134, 154, 190, 225, 229, 289 and 336 |
| 134, 154, 190, 225, 229, 303 and 336 | 134, 154, 190, 225, 258, 289 and 303 | 134, 154, 190, 225, 258, 289 and 336 | 134, 154, 190, 225, 258, 303 and 336 | 134, 154, 190, 225, 289, 303 and 336 |
| 134, 154, 190, 229, 258, 289 and 303 | 134, 154, 190, 229, 258, 289 and 336 | 134, 154, 190, 229, 258, 303 and 336 | 134, 154, 190, 229, 289, 303 and 336 | 134, 154, 190, 258, 289, 303 and 336 |
| 134, 154, 225, 229, 258, 289 and 303 | 134, 154, 225, 229, 258, 289 and 336 | 134, 154, 225, 229, 258, 303 and 336 | 134, 154, 225, 229, 289, 303 and 336 | 134, 154, 225, 258, 289, 303 and 336 |
| 134, 154, 229, 258, 289, 303 and 336 | 134, 190, 225, 229, 258, 289 and 303 | 134, 190, 225, 229, 258, 289 and 336 | 134, 190, 225, 229, 258, 303 and 336 | 134, 190, 225, 229, 289, 303 and 336 |
| 134, 190, 225, 258, 289, 303 and 336 | 134, 190, 229, 258, 289, 303 and 336 | 134, 225, 229, 258, 289, 303 and 336 | 154, 190, 225, 229, 258, 289 and 303 | 154, 190, 225, 229, 258, 289 and 336 |
| 154, 190, 225, 229, 258, 303 and 336 | 154, 190, 225, 229, 289, 303 and 336 | 154, 190, 225, 258, 289, 303 and 336 | 154, 190, 229, 258, 289, 303 and 336 | 154, 225, 229, 258, 289, 303 and 336 |
| 190, 225, 229, 258, 289, 303 and 336 | 85, 121, 130, 134, 154, 190, 225 and 229 | 85, 121, 130, 134, 154, 190, 225 and 258 | 85, 121, 130, 134, 154, 190, 225 and 289 | 85, 121, 130, 134, 154, 190, 225 and 303 |
| 85, 121, 130, 134, 154, 190, 225 and 336 | 85, 121, 130, 134, 154, 190, 229 and 258 | 85, 121, 130, 134, 154, 190, 229 and 289 | 85, 121, 130, 134, 154, 190, 229 and 303 | 85, 121, 130, 134, 154, 190, 229 and 336 |
| 85, 121, 130, 134, 154, 190, 258 and 289 | 85, 121, 130, 134, 154, 190, 258 and 303 | 85, 121, 130, 134, 154, 190, 258 and 336 | 85, 121, 130, 134, 154, 190, 289 and 303 | 85, 121, 130, 134, 154, 190, 289 and 336 |
| 85, 121, 130, 134, 154, 190, 303 and 336 | 85, 121, 130, 134, 154, 225, 229 and 258 | 85, 121, 130, 134, 154, 225, 229 and 289 | 85, 121, 130, 134, 154, 225, 229 and 303 | 85, 121, 130, 134, 154, 225, 229 and 336 |
| 85, 121, 130, 134, 154, 225, 258 and 289 | 85, 121, 130, 134, 154, 225, 258 and 303 | 85, 121, 130, 134, 154, 225, 258 and 336 | 85, 121, 130, 134, 154, 225, 289 and 303 | 85, 121, 130, 134, 154, 225, 289 and 336 |
| 85, 121, 130, 134, 154, 225, 303 and 336 | 85, 121, 130, 134, 154, 229, 258 and 289 | 85, 121, 130, 134, 154, 229, 258 and 303 | 85, 121, 130, 134, 154, 229, 258 and 336 | 85, 121, 130, 134, 154, 229, 289 and 303 |
| 85, 121, 130, 134, 154, 229, 289 and 336 | 85, 121, 130, 134, 154, 229, 303 and 336 | 85, 121, 130, 134, 154, 258, 289 and 303 | 85, 121, 130, 134, 154, 258, 289 and 336 | 85, 121, 130, 134, 154, 258, 303 and 336 |
| 85, 121, 130, 134, 154, 289, 303 and 336 | 85, 121, 130, 134, 190, 225, 229 and 258 | 85, 121, 130, 134, 190, 225, 229 and 289 | 85, 121, 130, 134, 190, 225, 229 and 303 | 85, 121, 130, 134, 190, 225, 229 and 336 |
| 85, 121, 130, 134, 190, 225, 258 and 289 | 85, 121, 130, 134, 190, 225, 258 and 303 | 85, 121, 130, 134, 190, 225, 258 and 336 | 85, 121, 130, 134, 190, 225, 289 and 303 | 85, 121, 130, 134, 190, 225, 289 and 336 |
| 85, 121, 130, 134, 190, 225, 303 and 336 | 85, 121, 130, 134, 190, 229, 258 and 289 | 85, 121, 130, 134, 190, 229, 258 and 303 | 85, 121, 130, 134, 190, 229, 258 and 336 | 85, 121, 130, 134, 190, 229, 289 and 303 |
| 85, 121, 130, 134, 190, 229, 289 and 336 | 85, 121, 130, 134, 190, 229, 303 and 336 | 85, 121, 130, 134, 190, 258, 289 and 303 | 85, 121, 130, 134, 190, 258, 289 and 336 | 85, 121, 130, 134, 190, 258, 303 and 336 |
| 85, 121, 130, 134, 190, 289, 303 and 336 | 85, 121, 130, 134, 225, 229, 258 and 289 | 85, 121, 130, 134, 225, 229, 258 and 303 | 85, 121, 130, 134, 225, 229, 258 and 336 | 85, 121, 130, 134, 225, 229, 289 and 303 |

TABLE 20-continued

Non-limiting examples of positions that may comprise a mutation, or a set of mutations [as compared to SEQ ID NO: 35]

| | | | | |
|---|---|---|---|---|
| 85, 121, 130, 134, 225, 229, 289 and 336 | 85, 121, 130, 134, 225, 229, 303 and 336 | 85, 121, 130, 134, 225, 258, 289 and 336 | 85, 121, 130, 134, 225, 258, 289 and 336 | 85, 121, 130, 134, 225, 258, 303 and 336 |
| 85, 121, 130, 134, 225, 289, 303 and 336 | 85, 121, 130, 134, 229, 258, 289 and 303 | 85, 121, 130, 134, 229, 258, 289 and 336 | 85, 121, 130, 134, 229, 258, 303 and 336 | 85, 121, 130, 134, 229, 289, 303 and 336 |
| 85, 121, 130, 134, 258, 289, 303 and 336 | 85, 121, 130, 154, 190, 225, 229 and 258 | 85, 121, 130, 154, 190, 225, 229 and 289 | 85, 121, 130, 154, 190, 225, 229 and 303 | 85, 121, 130, 154, 190, 225, 229 and 336 |
| 85, 121, 130, 154, 190, 225, 258 and 289 | 85, 121, 130, 154, 190, 225, 258 and 303 | 85, 121, 130, 154, 190, 225, 258 and 336 | 85, 121, 130, 154, 190, 225, 289 and 303 | 85, 121, 130, 154, 190, 225, 289 and 336 |
| 85, 121, 130, 154, 190, 225, 303 and 336 | 85, 121, 130, 154, 190, 229, 258 and 289 | 85, 121, 130, 154, 190, 229, 258 and 303 | 85, 121, 130, 154, 190, 229, 258 and 336 | 85, 121, 130, 154, 190, 229, 289 and 303 |
| 85, 121, 130, 154, 190, 229, 289 and 336 | 85, 121, 130, 154, 190, 229, 303 and 336 | 85, 121, 130, 154, 190, 258, 289 and 303 | 85, 121, 130, 154, 190, 258, 289 and 336 | 85, 121, 130, 154, 190, 258, 303 and 336 |
| 85, 121, 130, 154, 190, 289, 303 and 336 | 85, 121, 130, 154, 225, 229, 258 and 289 | 85, 121, 130, 154, 225, 229, 258 and 303 | 85, 121, 130, 154, 225, 229, 258 and 336 | 85, 121, 130, 154, 225, 229, 289 and 303 |
| 85, 121, 130, 154, 225, 229, 289 and 336 | 85, 121, 130, 154, 225, 229, 303 and 336 | 85, 121, 130, 154, 225, 258, 289 and 303 | 85, 121, 130, 154, 225, 258, 289 and 336 | 85, 121, 130, 154, 225, 258, 303 and 336 |
| 85, 121, 130, 154, 225, 289, 303 and 336 | 85, 121, 130, 154, 229, 258, 289 and 303 | 85, 121, 130, 154, 229, 258, 289 and 336 | 85, 121, 130, 154, 229, 258, 303 and 336 | 85, 121, 130, 154, 229, 289, 303 and 336 |
| 85, 121, 130, 154, 258, 289, 303 and 336 | 85, 121, 130, 190, 225, 229, 258 and 289 | 85, 121, 130, 190, 225, 229, 258 and 303 | 85, 121, 130, 190, 225, 229, 258 and 336 | 85, 121, 130, 190, 225, 229, 289 and 303 |
| 85, 121, 130, 190, 225, 229, 289 and 336 | 85, 121, 130, 190, 225, 229, 303 and 336 | 85, 121, 130, 190, 225, 258, 289 and 303 | 85, 121, 130, 190, 225, 258, 289 and 336 | 85, 121, 130, 190, 225, 258, 303 and 336 |
| 85, 121, 130, 190, 225, 289, 303 and 336 | 85, 121, 130, 190, 229, 258, 289 and 303 | 85, 121, 130, 190, 229, 258, 289 and 336 | 85, 121, 130, 190, 229, 258, 303 and 336 | 85, 121, 130, 190, 229, 289, 303 and 336 |
| 85, 121, 130, 190, 258, 289, 303 and 336 | 85, 121, 130, 225, 229, 258, 289 and 303 | 85, 121, 130, 225, 229, 258, 289 and 336 | 85, 121, 130, 225, 229, 258, 303 and 336 | 85, 121, 130, 225, 229, 289, 303 and 336 |
| 85, 121, 130, 225, 258, 289, 303 and 336 | 85, 121, 130, 229, 258, 289, 303 and 336 | 85, 121, 134, 154, 190, 225, 229 and 258 | 85, 121, 134, 154, 190, 225, 229 and 289 | 85, 121, 134, 154, 190, 225, 229 and 303 |
| 85, 121, 134, 154, 190, 225, 229 and 336 | 85, 121, 134, 154, 190, 225, 258 and 289 | 85, 121, 134, 154, 190, 225, 258 and 303 | 85, 121, 134, 154, 190, 225, 258 and 336 | 85, 121, 134, 154, 190, 225, 289 and 303 |
| 85, 121, 134, 154, 190, 225, 289 and 336 | 85, 121, 134, 154, 190, 225, 303 and 336 | 85, 121, 134, 154, 190, 229, 258 and 289 | 85, 121, 134, 154, 190, 229, 258 and 303 | 85, 121, 134, 154, 190, 229, 258 and 336 |
| 85, 121, 134, 154, 190, 229, 289 and 303 | 85, 121, 134, 154, 190, 229, 289 and 336 | 85, 121, 134, 154, 190, 229, 303 and 336 | 85, 121, 134, 154, 190, 258, 289 and 303 | 85, 121, 134, 154, 190, 258, 289 and 336 |
| 85, 121, 134, 154, 190, 258, 303 and 336 | 85, 121, 134, 154, 190, 289, 303 and 336 | 85, 121, 134, 154, 225, 229, 258 and 289 | 85, 121, 134, 154, 225, 229, 258 and 303 | 85, 121, 134, 154, 225, 229, 258 and 336 |
| 85, 121, 134, 154, 225, 229, 289 and 303 | 85, 121, 134, 154, 225, 229, 289 and 336 | 85, 121, 134, 154, 225, 229, 303 and 336 | 85, 121, 134, 154, 225, 258, 289 and 303 | 85, 121, 134, 154, 225, 258, 289 and 336 |
| 85, 121, 134, 154, 225, 258, 303 and 336 | 85, 121, 134, 154, 225, 289, 303 and 336 | 85, 121, 134, 154, 229, 258, 289 and 336 | 85, 121, 134, 154, 229, 258, 303 and 336 | 85, 121, 134, 154, 229, 258, 303 and 336 |
| 85, 121, 134, 154, 229, 289, 303 and 336 | 85, 121, 134, 154, 258, 289, 303 and 336 | 85, 121, 134, 190, 225, 229, 258 and 289 | 85, 121, 134, 190, 225, 229, 258 and 303 | 85, 121, 134, 190, 225, 229, 258 and 336 |
| 85, 121, 134, 190, 225, 229, 289 and 303 | 85, 121, 134, 190, 225, 229, 289 and 336 | 85, 121, 134, 190, 225, 229, 303 and 336 | 85, 121, 134, 190, 225, 258, 289 and 303 | 85, 121, 134, 190, 225, 258, 289 and 336 |
| 85, 121, 134, 190, 225, 258, 303 and 336 | 85, 121, 134, 190, 225, 289, 303 and 336 | 85, 121, 134, 190, 229, 258, 289 and 303 | 85, 121, 134, 190, 229, 258, 289 and 336 | 85, 121, 134, 190, 229, 258, 303 and 336 |
| 85, 121, 134, 190, 229, 289, 303 and 336 | 85, 121, 134, 190, 258, 289, 303 and 336 | 85, 121, 134, 225, 229, 258, 289 and 303 | 85, 121, 134, 225, 229, 258, 289 and 336 | 85, 121, 134, 225, 229, 258, 303 and 336 |
| 85, 121, 134, 225, 229, 289, 303 and 336 | 85, 121, 134, 225, 258, 289, 303 and 336 | 85, 121, 134, 229, 258, 289, 303 and 336 | 85, 121, 154, 190, 225, 229, 258 and 289 | 85, 121, 154, 190, 225, 229, 258 and 303 |
| 85, 121, 154, 190, 225, 229, 258 and 336 | 85, 121, 154, 190, 225, 229, 289 and 303 | 85, 121, 154, 190, 225, 229, 289 and 336 | 85, 121, 154, 190, 225, 229, 303 and 336 | 85, 121, 154, 190, 225, 258, 289 and 303 |
| 85, 121, 154, 190, 225, 258, 289 and 336 | 85, 121, 154, 190, 225, 258, 303 and 336 | 85, 121, 154, 190, 225, 289, 303 and 336 | 85, 121, 154, 190, 229, 258, 289 and 303 | 85, 121, 154, 190, 229, 258, 289 and 336 |
| 85, 121, 154, 190, 229, 258, 303 and 336 | 85, 121, 154, 190, 229, 289, 303 and 336 | 85, 121, 154, 190, 258, 289, 303 and 336 | 85, 121, 154, 225, 229, 258, 289 and 303 | 85, 121, 154, 225, 229, 258, 289 and 336 |
| 85, 121, 154, 225, 229, 258, 303 and 336 | 85, 121, 154, 225, 229, 289, 303 and 336 | 85, 121, 154, 225, 258, 289, 303 and 336 | 85, 121, 154, 229, 258, 289, 303 and 336 | 85, 121, 190, 225, 229, 258, 289 and 303 |
| 85, 121, 190, 225, 229, 258, 289 and 336 | 85, 121, 190, 225, 229, 258, 303 and 336 | 85, 121, 190, 225, 229, 289, 303 and 336 | 85, 121, 190, 225, 258, 289, 303 and 336 | 85, 121, 190, 229, 258, 289, 303 and 336 |
| 85, 121, 225, 229, 258, 289, 303 and 336 | 85, 130, 134, 154, 190, 225, 229 and 258 | 85, 130, 134, 154, 190, 225, 229 and 289 | 85, 130, 134, 154, 190, 225, 229 and 303 | 85, 130, 134, 154, 190, 225, 229 and 336 |
| 85, 130, 134, 154, 190, 225, 258 and 289 | 85, 130, 134, 154, 190, 225, 258 and 303 | 85, 130, 134, 154, 190, 225, 258 and 336 | 85, 130, 134, 154, 190, 225,289 and 303 | 85, 130, 134, 154, 190, 225, 289 and 336 |
| 85, 130, 134, 154, 190, 225, 303 and 336 | 85, 130, 134, 154, 190, 229, 258 and 289 | 85, 130, 134, 154, 190, 229, 258 and 303 | 85, 130, 134, 154, 190, 229, 258 and 336 | 85, 130, 134, 154, 190, 229, 289 and 303 |
| 85, 130, 134, 154, 190, 229, 289 and 336 | 85, 130, 134, 154, 190, 229, 303 and 336 | 85, 130, 134, 154, 190, 258, 289 and 303 | 85, 130, 134, 154, 190, 258, 289 and 336 | 85, 130, 134, 154, 190, 258, 303 and 336 |
| 85, 130, 134, 154, 190, 289, 303 and 336 | 85, 130, 134, 154, 225, 229, 258 and 289 | 85, 130, 134, 154, 225, 229, 258 and 303 | 85, 130, 134, 154, 225, 229, 258 and 336 | 85, 130, 134, 154, 225, 229, 289 and 303 |
| 85, 130, 134, 154, 225, 229, 289 and 336 | 85, 130, 134, 154, 225, 229, 303 and 336 | 85, 130, 134, 154, 225, 258, 289 and 303 | 85, 130, 134, 154, 225, 258, 289 and 336 | 85, 130, 134, 154, 225, 258, 303 and 336 |
| 85, 130, 134, 154, 225, 289, 303 and 336 | 85, 130, 134, 154, 229, 258, 289 and 303 | 85, 130, 134, 154, 229, 258, 289 and 336 | 85, 130, 134, 154, 229, 258, 303 and 336 | 85, 130, 134, 154, 229, 289, 303 and 336 |
| 85, 130, 134, 154, 258, 289, 303 and 336 | 85, 130, 134, 190, 225, 229, 258 and 289 | 85, 130, 134, 190, 225, 229, 258 and 303 | 85, 130, 134, 190, 225, 229, 258 and 336 | 85, 130, 134, 190, 225, 229, 289 and 303 |
| 85, 130, 134, 190, 225, 229, 289 and 336 | 85, 130, 134, 190, 225, 229, 303 and 336 | 85, 130, 134, 190, 225, 258, 289 and 303 | 85, 130, 134, 190, 225, 258, 289 and 336 | 85, 130, 134, 190, 225, 258, 303 and 336 |

TABLE 20-continued

| Non-limiting examples of positions that may comprise a mutation, or a set of mutations [as compared to SEQ ID NO: 35] | | | | |
|---|---|---|---|---|
| 85, 130, 134, 190, 225, 289, 303 and 336 | 85, 130, 134, 190, 229, 258, 289 and 303 | 85, 130, 134, 190, 229, 258, 289 and 336 | 85, 130, 134, 190, 229, 258, 303 and 336 | 85, 130, 134, 190, 229, 289, 303 and 336 |
| 85, 130, 134, 190, 258, 289, 303 and 336 | 85, 130, 134, 225, 229, 258, 289 and 303 | 85, 130, 134, 225, 229, 258, 289 and 336 | 85, 130, 134, 225, 229, 258, 303 and 336 | 85, 130, 134, 225, 229, 289, 303 and 336 |
| 85, 130, 134, 225, 258, 289, 303 and 336 | 85, 130, 134, 229, 258, 289, 303 and 336 | 85, 130, 154, 190, 225, 229, 258 and 289 | 85, 130, 154, 190, 225, 229, 258 and 303 | 85, 130, 154, 190, 225, 229, 258 and 336 |
| 85, 130, 154, 190, 225, 229, 289 and 303 | 85, 130, 154, 190, 225, 229, 289 and 336 | 85, 130, 154, 190, 225, 229, 303 and 336 | 85, 130, 154, 190, 225, 258, 289 and 303 | 85, 130, 154, 190, 225, 258, 289 and 336 |
| 85, 130, 154, 190, 225, 258, 303 and 336 | 85, 130, 154, 190, 225, 289, 303 and 336 | 85, 130, 154, 190, 229, 258, 289 and 303 | 85, 130, 154, 190, 229, 258, 289 and 336 | 85, 130, 154, 190, 229, 258, 303 and 336 |
| 85, 130, 154, 190, 229, 289, 303 and 336 | 85, 130, 154, 190, 258, 289, 303 and 336 | 85, 130, 154, 225, 229, 258, 289 and 303 | 85, 130, 154, 225, 229, 258, 289 and 336 | 85, 130, 154, 225, 229, 258, 303 and 336 |
| 85, 130, 154, 225, 229, 289, 303 and 336 | 85, 130, 154, 225, 258, 289, 303 and 336 | 85, 130, 154, 229, 258, 289, 303 and 336 | 85, 130, 190, 225, 229, 258, 289 and 303 | 85, 130, 190, 225, 229, 258, 289 and 336 |
| 85, 130, 190, 225, 229, 258, 303 and 336 | 85, 130, 190, 225, 229, 289, 303 and 336 | 85, 130, 190, 225, 258, 289, 303 and 336 | 85, 130, 190, 229, 258, 289, 303 and 336 | 85, 130, 225, 229, 258, 289, 303 and 336 |
| 85, 134, 154, 190, 225, 229, 258 and 289 | 85, 134, 154, 190, 225, 229, 258 and 303 | 85, 134, 154, 190, 225, 229, 258 and 336 | 85, 134, 154, 190, 225, 229, 289 and 303 | 85, 134, 154, 190, 225, 229, 289 and 336 |
| 85, 134, 154, 190, 225, 229, 303 and 336 | 85, 134, 154, 190, 225, 258, 289 and 303 | 85, 134, 154, 190, 225, 258, 289 and 336 | 85, 134, 154, 190, 225, 258, 303 and 336 | 85, 134, 154, 190, 225, 289, 303 and 336 |
| 85, 134, 154, 190, 229, 258, 289 and 303 | 85, 134, 154, 190, 229, 258, 289 and 336 | 85, 134, 154, 190, 229, 258, 303 and 336 | 85, 134, 154, 190, 229, 289, 303 and 336 | 85, 134, 154, 190, 258, 289, 303 and 336 |
| 85, 134, 154, 225, 229, 258, 289 and 303 | 85, 134, 154, 225, 229, 258, 289 and 336 | 85, 134, 154, 225, 229, 258, 303 and 336 | 85, 134, 154, 225, 229, 289, 303 and 336 | 85, 134, 154, 225, 258, 289, 303 and 336 |
| 85, 134, 154, 229, 258, 289, 303 and 336 | 85, 134, 190, 225, 229, 258, 289 and 303 | 85, 134, 190, 225, 229, 258, 289 and 336 | 85, 134, 190, 225, 229, 258, 303 and 336 | 85, 134, 190, 225, 229, 289, 303 and 336 |
| 85, 134, 190, 225, 258, 289, 303 and 336 | 85, 134, 190, 229, 258, 289, 303 and 336 | 85, 134, 225, 229, 258, 289, 303 and 336 | 85, 154, 190, 225, 229, 258, 289 and 303 | 85, 154, 190, 225, 229, 258, 289 and 336 |
| 85, 154, 190, 225, 229, 258, 303 and 336 | 85, 154, 190, 225, 229, 289, 303 and 336 | 85, 154, 190, 225, 258, 289, 303 and 336 | 85, 154, 190, 229, 258, 289, 303 and 336 | 85, 154, 225, 229, 258, 289, 303 and 336 |
| 85, 190, 225, 229, 258, 289, 303 and 336 | 121, 130, 134, 154, 190, 225, 229 and 258 | 121, 130, 134, 154, 190, 225, 229 and 289 | 121, 130, 134, 154, 190, 225, 229 and 303 | 121, 130, 134, 154, 190, 225, 229 and 336 |
| 121, 130, 134, 154, 190, 225, 258 and 289 | 121, 130, 134, 154, 190, 225, 258 and 303 | 121, 130, 134, 154, 190, 225, 258 and 336 | 121, 130, 134, 154, 190, 225, 289 and 303 | 121, 130, 134, 154, 190, 225, 289 and 336 |
| 121, 130, 134, 154, 190, 225, 303 and 336 | 121, 130, 134, 154, 190, 229, 258 and 289 | 121, 130, 134, 154, 190, 229, 258 and 303 | 121, 130, 134, 154, 190, 229, 258 and 336 | 121, 130, 134, 154, 190, 229, 289 and 303 |
| 121, 130, 134, 154, 190, 229, 289 and 336 | 121, 130, 134, 154, 190, 229, 303 and 336 | 121, 130, 134, 154, 190, 258, 289 and 303 | 121, 130, 134, 154, 190, 258, 289 and 336 | 121, 130, 134, 154, 190, 258, 303 and 336 |
| 121, 130, 134, 154, 190, 289, 303 and 336 | 121, 130, 134, 154, 225, 229, 258 and 289 | 121, 130, 134, 154, 225, 229, 258 and 303 | 121, 130, 134, 154, 225, 229, 258 and 336 | 121, 130, 134, 154, 225, 229, 289 and 303 |
| 121, 130, 134, 154, 225, 229, 289 and 336 | 121, 130, 134, 154, 225, 229, 303 and 336 | 121, 130, 134, 154, 225, 258, 289 and 303 | 121, 130, 134, 154, 225, 258, 289 and 336 | 121, 130, 134, 154, 225, 258, 303 and 336 |
| 121, 130, 134, 154, 225, 289, 303 and 336 | 121, 130, 134, 154, 229, 258, 289 and 303 | 121, 130, 134, 154, 229, 258, 289 and 336 | 121, 130, 134, 154, 229, 258, 303 and 336 | 121, 130, 134, 154, 229, 289, 303 and 336 |
| 121, 130, 134, 154, 258, 289, 303 and 336 | 121, 130, 134, 190, 225, 229, 258 and 289 | 121, 130, 134, 190, 225, 229, 258 and 303 | 121, 130, 134, 190, 225, 229, 258 and 336 | 121, 130, 134, 190, 225, 229, 289 and 303 |
| 121, 130, 134, 190, 225, 229, 289 and 336 | 121, 130, 134, 190, 225, 229, 303 and 336 | 121, 130, 134, 190, 225, 258, 289 and 303 | 121, 130, 134, 190, 225, 258, 289 and 336 | 121, 130, 134, 190, 225, 258, 303 and 336 |
| 121, 130, 134, 190, 225, 289, 303 and 336 | 121, 130, 134, 190, 229, 258, 289 and 303 | 121, 130, 134, 190, 229, 258, 289 and 336 | 121, 130, 134, 190, 229, 258, 303 and 336 | 121, 130, 134, 190, 229, 289, 303 and 336 |
| 121, 130, 134, 190, 258, 289, 303 and 336 | 121, 130, 134, 225, 229, 258, 289 and 303 | 121, 130, 134, 225, 229, 258, 289 and 336 | 121, 130, 134, 225, 229, 258, 303 and 336 | 121, 130, 134, 225, 229, 289, 303 and 336 |
| 121, 130, 134, 225, 258, 289, 303 and 336 | 121, 130, 134, 229, 258, 289, 303 and 336 | 121, 130, 154, 190, 225, 229, 258 and 289 | 121, 130, 154, 190, 225, 229, 258 and 303 | 121, 130, 154, 190, 225, 229, 258 and 336 |
| 121, 130, 154, 190, 225, 229, 289 and 303 | 121, 130, 154, 190, 225, 229, 289 and 336 | 121, 130, 154, 190, 225, 229, 303 and 336 | 121, 130, 154, 190, 225, 258, 289 and 303 | 121, 130, 154, 190, 225, 258, 289 and 336 |
| 121, 130, 154, 190, 225, 258, 303 and 336 | 121, 130, 154, 190, 225, 289, 303 and 336 | 121, 130, 154, 190, 229, 258, 289 and 303 | 121, 130, 154, 190, 229, 258, 289 and 336 | 121, 130, 154, 190, 229, 258, 303 and 336 |
| 121, 130, 154, 190, 229, 289, 303 and 336 | 121, 130, 154, 190, 258, 289, 303 and 336 | 121, 130, 154, 225, 229, 258, 289 and 303 | 121, 130, 154, 225, 229, 258, 289 and 336 | 121, 130, 154, 225, 229, 258, 303 and 336 |
| 121, 130, 154, 225, 229, 289, 303 and 336 | 121, 130, 154, 225, 258, 289, 303 and 336 | 121, 130, 154, 229, 258, 289, 303 and 336 | 121, 130, 190, 225, 229, 258, 289 and 303 | 121, 130, 190, 225, 229, 258, 289 and 336 |
| 121, 130, 190, 225, 229, 258, 303 and 336 | 121, 130, 190, 225, 229, 289, 303 and 336 | 121, 130, 190, 225, 258, 289, 303 and 336 | 121, 130, 190, 229, 258, 289, 303 and 336 | 121, 130, 225, 229, 258, 289, 303 and 336 |
| 121, 134, 154, 190, 225, 229, 258 and 289 | 121, 134, 154, 190, 225, 229, 258 and 303 | 121, 134, 154, 190, 225, 229, 258 and 336 | 121, 134, 154, 190, 225, 229, 289 and 303 | 121, 134, 154, 190, 225, 229, 289 and 336 |
| 121, 134, 154, 190, 225, 229, 303 and 336 | 121, 134, 154, 190, 225, 258, 289 and 303 | 121, 134, 154, 190, 225, 258, 289 and 336 | 121, 134, 154, 190, 225, 258, 303 and 336 | 121, 134, 154, 190, 225, 289, 303 and 336 |
| 121, 134, 154, 190, 229, 258, 289 and 303 | 121, 134, 154, 190, 229, 258, 289 and 336 | 121, 134, 154, 190, 229, 258, 303 and 336 | 121, 134, 154, 190, 229, 289, 303 and 336 | 121, 134, 154, 190, 258, 289, 303 and 336 |
| 121, 134, 154, 225, 229, 258, 289 and 303 | 121, 134, 154, 225, 229, 258, 289 and 336 | 121, 134, 154, 225, 229, 258, 303 and 336 | 121, 134, 154, 225, 229, 289, 303 and 336 | 121, 134, 154, 225, 258, 289, 303 and 336 |
| 121, 134, 154, 229, 258, 289, 303 and 336 | 121, 134, 190, 225, 229, 258, 289 and 303 | 121, 134, 190, 225, 229, 258, 289 and 336 | 121, 134, 190, 225, 229, 258, 303 and 336 | 121, 134, 190, 225, 229, 289, 303 and 336 |
| 121, 134, 190, 225, 258, 289, 303 and 336 | 121, 134, 190, 229, 258, 289, 303 and 336 | 121, 134, 225, 229, 258, 289, 303 and 336 | 121, 154, 190, 225, 229, 258, 289 and 303 | 121, 154, 190, 225, 229, 258, 289 and 336 |
| 121, 154, 190, 225, 229, 258, 303 and 336 | 121, 154, 190, 225, 229, 289, 303 and 336 | 121, 154, 190, 225, 258, 289, 303 and 336 | 121, 154, 190, 229, 258, 289, 303 and 336 | 121, 154, 225, 229, 258, 289, 303 and 336 |

TABLE 20-continued

| Non-limiting examples of positions that may comprise a mutation, or a set of mutations [as compared to SEQ ID NO: 35] | | | | |
|---|---|---|---|---|
| 121, 190, 225, 229, 258, 289, 303 and 336 | 130, 134, 154, 190, 225, 229, 258 and 289 | 130, 134, 154, 190, 225, 229, 258 and 303 | 130, 134, 154, 190, 225, 229, 258 and 336 | 130, 134, 154, 190, 225, 229, 289 and 303 |
| 130, 134, 154, 190, 225, 229, 289 and 336 | 130, 134, 154, 190, 225, 229, 303 and 336 | 130, 134, 154, 190, 225, 258, 289 and 303 | 130, 134, 154, 190, 225, 258, 289 and 336 | 130, 134, 154, 190, 225, 258, 303 and 336 |
| 130, 134, 154, 190, 225, 289, 303 and 336 | 130, 134, 154, 190, 229, 258, 289 and 303 | 130, 134, 154, 190, 229, 258, 289 and 336 | 130, 134, 154, 190, 229, 258, 303 and 336 | 130, 134, 154, 190, 229, 289, 303 and 336 |
| 130, 134, 154, 190, 258, 289, 303 and 336 | 130, 134, 154, 225, 229, 258, 289 and 303 | 130, 134, 154, 225, 229, 258, 289 and 336 | 130, 134, 154, 225, 229, 258, 303 and 336 | 130, 134, 154, 225, 229, 289, 303 and 336 |
| 130, 134, 154, 225, 258, 289, 303 and 336 | 130, 134, 154, 229, 258, 289, 303 and 336 | 130, 134, 190, 225, 229, 258, 289 and 303 | 130, 134, 190, 225, 229, 258, 289 and 336 | 130, 134, 190, 225, 229, 258, 303 and 336 |
| 130, 134, 190, 225, 229, 289, 303 and 336 | 130, 134, 190, 225, 258, 289, 303 and 336 | 130, 134, 190, 229, 258, 289, 303 and 336 | 130, 134, 225, 229, 258, 289, 303 and 336 | 130, 154, 190, 225, 229, 258, 289 and 303 |
| 130, 154, 190, 225, 229, 258, 289 and 336 | 130, 154, 190, 225, 229, 258, 303 and 336 | 130, 154, 190, 225, 229, 289, 303 and 336 | 130, 154, 190, 225, 258, 289, 303 and 336 | 130, 154, 190, 229, 258, 289, 303 and 336 |
| 130, 154, 225, 229, 258, 289, 303 and 336 | 130, 190, 225, 229, 258, 289, 303 and 336 | 134, 154, 190, 225, 229, 258, 289 and 303 | 134, 154, 190, 225, 229, 258, 289 and 336 | 134, 154, 190, 225, 229, 258, 303 and 336 |
| 134, 154, 190, 225, 229, 289, 303 and 336 | 134, 154, 190, 225, 258, 289, 303 and 336 | 134, 154, 190, 229, 258, 289, 303 and 336 | 134, 154, 225, 229, 258, 289, 303 and 336 | 134, 190, 225, 229, 258, 289, 303 and 336 |
| 154, 190, 225, 229, 258, 289, 303 and 336 | 85, 121, 130, 134, 154, 190, 225, 229 and 258 | 85, 121, 130, 134, 154, 190, 225, 229 and 289 | 85, 121, 130, 134, 154, 190, 225, 229 and 303 | 85, 121, 130, 134, 154, 190, 225, 229 and 336 |
| 85, 121, 130, 134, 154, 190, 225, 258 and 289 | 85, 121, 130, 134, 154, 190, 225, 258 and 303 | 85, 121, 130, 134, 154, 190, 225, 258 and 336 | 85, 121, 130, 134, 154, 190, 225, 289 and 303 | 85, 121, 130, 134, 154, 190, 225, 289 and 336 |
| 85, 121, 130, 134, 154, 190, 225, 303 and 336 | 85, 121, 130, 134, 154, 190, 229, 258 and 289 | 85, 121, 130, 134, 154, 190, 229, 258 and 303 | 85, 121, 130, 134, 154, 190, 229, 258 and 336 | 85, 121, 130, 134, 154, 190, 229, 289 and 303 |
| 85, 121, 130, 134, 154, 190, 229, 289 and 336 | 85, 121, 130, 134, 154, 190, 229, 303 and 336 | 85, 121, 130, 134, 154, 190, 258, 289 and 303 | 85, 121, 130, 134, 154, 190, 258, 289 and 336 | 85, 121, 130, 134, 154, 190, 258, 303 and 336 |
| 85, 121, 130, 134, 154, 190, 289, 303 and 336 | 85, 121, 130, 134, 154, 225, 229, 258 and 289 | 85, 121, 130, 134, 154, 225, 229, 258 and 303 | 85, 121, 130, 134, 154, 225, 229, 258 and 336 | 85, 121, 130, 134, 154, 225, 229, 289 and 303 |
| 85, 121, 130, 134, 154, 225, 229, 289 and 336 | 85, 121, 130, 134, 154, 225, 229, 303 and 336 | 85, 121, 130, 134, 154, 225, 258, 289 and 303 | 85, 121, 130, 134, 154, 225, 258, 289 and 336 | 85, 121, 130, 134, 154, 225, 258, 303 and 336 |
| 85, 121, 130, 134, 154, 225, 289, 303 and 336 | 85, 121, 130, 134, 154, 229, 258, 289 and 303 | 85, 121, 130, 134, 154, 229, 258, 289 and 336 | 85, 121, 130, 134, 154, 229, 258, 303 and 336 | 85, 121, 130, 134, 154, 229, 289, 303 and 336 |
| 85, 121, 130, 134, 154, 258, 289, 303 and 336 | 85, 121, 130, 134, 190, 225, 229, 258 and 289 | 85, 121, 130, 134, 190, 225, 229, 258 and 303 | 85, 121, 130, 134, 190, 225, 229, 258 and 336 | 85, 121, 130, 134, 190, 225, 229, 289 and 303 |
| 85, 121, 130, 134, 190, 225, 229, 289 and 336 | 85, 121, 130, 134, 190, 225, 229, 303 and 336 | 85, 121, 130, 134, 190, 225, 258, 289 and 303 | 85, 121, 130, 134, 190, 225, 258, 289 and 336 | 85, 121, 130, 134, 190, 225, 258, 303 and 336 |
| 85, 121, 130, 134, 190, 225, 289, 303 and 336 | 85, 121, 130, 134, 190, 229, 258, 289 and 303 | 85, 121, 130, 134, 190, 229, 258, 289 and 336 | 85, 121, 130, 134, 190, 229, 258, 303 and 336 | 85, 121, 130, 134, 190, 229, 289, 303 and 336 |
| 85, 121, 130, 134, 190, 258, 289, 303 and 336 | 85, 121, 130, 134, 225, 229, 258, 289 and 303 | 85, 121, 130, 134, 225, 229, 258, 289 and 336 | 85, 121, 130, 134, 225, 229, 258, 303 and 336 | 85, 121, 130, 134, 225, 229, 289, 303 and 336 |
| 85, 121, 130, 134, 225, 258, 289, 303 and 336 | 85, 121, 130, 134, 229, 258, 289, 303 and 336 | 85, 121, 130, 154, 190, 225, 229, 258 and 289 | 85, 121, 130, 154, 190, 225, 229, 258 and 303 | 85, 121, 130, 154, 190, 225, 229, 258 and 336 |
| 85, 121, 130, 154, 190, 225, 229, 289 and 303 | 85, 121, 130, 154, 190, 225, 229, 289 and 336 | 85, 121, 130, 154, 190, 225, 229, 303 and 336 | 85, 121, 130, 154, 190, 225, 258, 289 and 303 | 85, 121, 130, 154, 190, 225, 258, 289 and 336 |
| 85, 121, 130, 154, 190, 225, 258, 303 and 336 | 85, 121, 130, 154, 190, 225, 289, 303 and 336 | 85, 121, 130, 154, 190, 229, 258, 289 and 303 | 85, 121, 130, 154, 190, 229, 258, 289 and 336 | 85, 121, 130, 154, 190, 229, 258, 303 and 336 |
| 85, 121, 130, 154, 190, 229, 289, 303 and 336 | 85, 121, 130, 154, 190, 258, 289, 303 and 336 | 85, 121, 130, 154, 225, 229, 258, 289 and 303 | 85, 121, 130, 154, 225, 229, 258, 289 and 336 | 85, 121, 130, 154, 225, 229, 258, 303 and 336 |
| 85, 121, 130, 154, 225, 229, 289, 303 and 336 | 85, 121, 130, 154, 225, 258, 289, 303 and 336 | 85, 121, 130, 154, 229, 258, 289, 303 and 336 | 85, 121, 130, 190, 225, 229, 258, 289 and 303 | 85, 121, 130, 190, 225, 229, 258, 289 and 336 |
| 85, 121, 130, 190, 225, 229, 258, 303 and 336 | 85, 121, 130, 190, 225, 229, 289, 303 and 336 | 85, 121, 130, 190, 225, 258, 289, 303 and 336 | 85, 121, 130, 190, 229, 258, 289, 303 and 336 | 85, 121, 130, 225, 229, 258, 289, 303 and 336 |
| 85, 121, 134, 154, 190, 225, 229, 258 and 289 | 85, 121, 134, 154, 190, 225, 229, 258 and 303 | 85, 121, 134, 154, 190, 225, 229, 258 and 336 | 85, 121, 134, 154, 190, 225, 229, 289 and 303 | 85, 121, 134, 154, 190, 225, 229, 289 and 336 |
| 85, 121, 134, 154, 190, 225, 229, 303 and 336 | 85, 121, 134, 154, 190, 225, 258, 289 and 303 | 85, 121, 134, 154, 190, 225, 258, 289 and 336 | 85, 121, 134, 154, 190, 225, 258, 303 and 336 | 85, 121, 134, 154, 190, 225, 289, 303 and 336 |
| 85, 121, 134, 154, 190, 229, 258, 289 and 303 | 85, 121, 134, 154, 190, 229, 258, 289 and 336 | 85, 121, 134, 154, 190, 229, 258, 303 and 336 | 85, 121, 134, 154, 190, 229, 289, 303 and 336 | 85, 121, 134, 154, 190, 258, 289, 303 and 336 |
| 85, 121, 134, 154, 225, 229, 258, 289 and 303 | 85, 121, 134, 154, 225, 229, 258, 289 and 336 | 85, 121, 134, 154, 225, 229, 258, 303 and 336 | 85, 121, 134, 154, 225, 229, 289, 303 and 336 | 85, 121, 134, 154, 225, 258, 289, 303 and 336 |
| 85, 121, 134, 154, 229, 258, 289, 303 and 336 | 85, 121, 134, 154, 190, 225, 229, 258 and 303 | 85, 121, 134, 190, 225, 229, 258, 289 and 336 | 85, 121, 134, 190, 225, 229, 258, 303 and 336 | 85, 121, 134, 190, 225, 229, 289, 303 and 336 |
| 85, 121, 134, 190, 225, 258, 289, 303 and 336 | 85, 121, 134, 190, 225, 229, 258, 289 and 303 | 85, 121, 134, 225, 229, 258, 289, 303 and 336 | 85, 121, 154, 190, 225, 229, 258, 289 and 303 | 85, 121, 154, 190, 225, 229, 258, 289 and 336 |
| 85, 121, 154, 190, 225, 229, 258, 303 and 336 | 85, 121, 154, 190, 225, 229, 289, 303 and 336 | 85, 121, 154, 190, 225, 258, 289, 303 and 336 | 85, 121, 154, 190, 229, 258, 289, 303 and 336 | 85, 121, 154, 225, 229, 258, 289, 303 and 336 |
| 85, 121, 190, 225, 229, 258, 289, 303 and 336 | 85, 130, 134, 154, 190, 225, 229, 258 and 289 | 85, 130, 134, 154, 190, 225, 229, 258 and 303 | 85, 130, 134, 154, 190, 225, 229, 258 and 336 | 85, 130, 134, 154, 190, 225, 229, 289 and 303 |
| 85, 130, 134, 154, 190, 225, 229, 289 and 336 | 85, 130, 134, 154, 190, 225, 229, 303 and 336 | 85, 130, 134, 154, 190, 225, 258, 289 and 303 | 85, 130, 134, 154, 190, 225, 258, 289 and 336 | 85, 130, 134, 154, 190, 225, 258, 303 and 336 |
| 85, 130, 134, 154, 190, 225, 289, 303 and 336 | 85, 130, 134, 154, 190, 229, 258, 289 and 303 | 85, 130, 134, 154, 190, 229, 258, 289 and 336 | 85, 130, 134, 154, 190, 229, 258, 303 and 336 | 85, 130, 134, 154, 190, 229, 289, 303 and 336 |
| 85, 130, 134, 154, 190, 258, 289, 303 and 336 | 85, 130, 134, 154, 225, 229, 258, 289 and 303 | 85, 130, 134, 154, 225, 229, 258, 289 and 336 | 85, 130, 134, 154, 225, 229, 258, 303 and 336 | 85, 130, 134, 154, 225, 229, 289, 303 and 336 |
| 85, 130, 134, 154, 225, 258, 289, 303 and 336 | 85, 130, 134, 154, 229, 258, 289, 303 and 336 | 85, 130, 134, 190, 225, 229, 258, 289 and 303 | 85, 130, 134, 190, 225, 229, 258, 289 and 336 | 85, 130, 134, 190, 225, 229, 258, 303 and 336 |
| 85, 130, 134, 190, 225, 229, 289, 303 and 336 | 85, 130, 134, 190, 225, 258, 289, 303 and 336 | 85, 130, 134, 190, 229, 258, 289, 303 and 336 | 85, 130, 134, 225, 229, 258, 289, 303 and 336 | 85, 130, 154, 190, 225, 229, 258, 289 and 303 |

TABLE 20-continued

Non-limiting examples of positions that may comprise a mutation, or a set of mutations [as compared to SEQ ID NO: 35]

| | | | | |
|---|---|---|---|---|
| 85, 130, 154, 190, 225, 229, 258, 289 and 336 | 85, 130, 154, 190, 225, 229, 258, 303 and 336 | 85, 130, 154, 190, 225, 229, 289, 303 and 336 | 85, 130, 154, 190, 225, 258, 289, 303 and 336 | 85, 130, 154, 190, 229, 258, 289, 303 and 336 |
| 85, 130, 154, 225, 229, 258, 289, 303 and 336 | 85, 130, 190, 225, 229, 258, 289, 303 and 336 | 85, 134, 154, 190, 225, 229, 258, 289 and 303 | 85, 134, 154, 190, 225, 229, 258, 289 and 336 | 85, 134, 154, 190, 225, 229, 258, 303 and 336 |
| 85, 134, 154, 190, 225, 229, 289, 303 and 336 | 85, 134, 154, 190, 225, 258, 289, 303 and 336 | 85, 134, 154, 190, 229, 258, 289, 303 and 336 | 85, 134, 154, 225, 229, 258, 289, 303 and 336 | 85, 134, 190, 225, 229, 258, 289, 303 and 336 |
| 85, 154, 190, 225, 229, 258, 289, 303 and 336 | 121, 130, 134, 154, 190, 225, 229, 258 and 289 | 121, 130, 134, 154, 190, 225, 229, 258 and 303 | 121, 130, 134, 154, 190, 225, 229, 258 and 336 | 121, 130, 134, 154, 190, 225, 229, 289 and 303 |
| 121, 130, 134, 154, 190, 225, 229, 289 and 336 | 121, 130, 134, 154, 190, 225, 229, 303 and 336 | 121, 130, 134, 154, 190, 225, 258, 289 and 303 | 121, 130, 134, 154, 190, 225, 258, 289 and 336 | 121, 130, 134, 154, 190, 225, 258, 303 and 336 |
| 121, 130, 134, 154, 190, 225, 289, 303 and 336 | 121, 130, 134, 154, 190, 229, 258, 289 and 303 | 121, 130, 134, 154, 190, 229, 258, 289 and 336 | 121, 130, 134, 154, 190, 229, 258, 303 and 336 | 121, 130, 134, 154, 190, 229, 289, 303 and 336 |
| 121, 130, 134, 154, 190, 258, 289, 303 and 336 | 121, 130, 134, 154, 225, 229, 258, 289 and 303 | 121, 130, 134, 154, 225, 229, 258, 289 and 336 | 121, 130, 134, 154, 225, 229, 258, 303 and 336 | 121, 130, 134, 154, 225, 229, 289, 303 and 336 |
| 121, 130, 134, 154, 225, 229, 258, 289, 303 and 336 | 121, 130, 134, 154, 190, 225, 229, 258, 289, 303 and 336 | 121, 130, 134, 154, 190, 225, 258, 289 and 303 | 121, 130, 134, 154, 190, 225, 258, 289 and 336 | 121, 130, 134, 190, 225, 229, 258, 303 and 336 |
| 121, 130, 134, 190, 225, 229, 289, 303 and 336 | 121, 130, 134, 190, 225, 258, 289, 303 and 336 | 121, 130, 134, 190, 229, 258, 289, 303 and 336 | 121, 130, 134, 225, 229, 258, 289, 303 and 336 | 121, 130, 154, 190, 225, 229, 258, 289 and 303 |
| 121, 130, 154, 190, 225, 229, 258, 289 and 336 | 121, 130, 154, 190, 225, 229, 258, 303 and 336 | 121, 130, 154, 190, 225, 229, 289, 303 and 336 | 121, 130, 154, 190, 225, 258, 289, 303 and 336 | 121, 130, 154, 190, 229, 258, 289, 303 and 336 |
| 121, 130, 154, 225, 229, 258, 289, 303 and 336 | 121, 130, 190, 225, 229, 258, 289, 303 and 336 | 121, 134, 154, 190, 225, 229, 258, 289 and 303 | 121, 134, 154, 190, 225, 229, 258, 289 and 336 | 121, 134, 154, 190, 225, 229, 258, 303 and 336 |
| 121, 134, 154, 190, 225, 229, 289, 303 and 336 | 121, 134, 154, 190, 225, 258, 289, 303 and 336 | 121, 134, 154, 190, 229, 258, 289, 303 and 336 | 121, 134, 154, 225, 229, 258, 289, 303 and 336 | 121, 134, 190, 225, 229, 258, 289, 303 and 336 |
| 121, 154, 190, 225, 229, 258, 289, 303 and 336 | 130, 134, 154, 190, 225, 229, 258, 289 and 303 | 130, 134, 154, 190, 225, 229, 258, 289 and 336 | 130, 134, 154, 190, 225, 229, 258, 303 and 336 | 130, 134, 154, 190, 225, 229, 289, 303 and 336 |
| 130, 134, 154, 190, 225, 229, 258, 289, 303 and 336 | 130, 134, 154, 190, 229, 258, 289, 303 and 336 | 130, 134, 154, 225, 229, 258, 289, 303 and 336 | 130, 134, 190, 225, 229, 258, 289, 303 and 336 | 130, 154, 190, 225, 229, 258, 289, 303 and 336 |
| 134, 154, 190, 225, 229, 258, 289, 303 and 336 | 85, 121, 130, 134, 154, 190, 225, 229, 258 and 289 | 85, 121, 130, 134, 154, 190, 225, 229, 258 and 303 | 85, 121, 130, 134, 154, 190, 225, 229, 258 and 336 | 85, 121, 130, 134, 154, 190, 225, 229, 289 and 303 |
| 85, 121, 130, 134, 154, 190, 225, 229, 289 and 336 | 85, 121, 130, 134, 154, 190, 225, 229, 303 and 336 | 85, 121, 130, 134, 154, 190, 225, 258, 289 and 303 | 85, 121, 130, 134, 154, 190, 225, 258, 289 and 336 | 85, 121, 130, 134, 154, 190, 225, 258, 303 and 336 |
| 85, 121, 130, 134, 154, 190, 225, 289, 303 and 336 | 85, 121, 130, 134, 154, 190, 229, 258, 289 and 303 | 85, 121, 130, 134, 154, 190, 229, 258, 289 and 336 | 85, 121, 130, 134, 154, 190, 229, 258, 303 and 336 | 85, 121, 130, 134, 154, 190, 229, 289, 303 and 336 |
| 85, 121, 130, 134, 154, 190, 258, 289, 303 and 336 | 85, 121, 130, 134, 154, 225, 229, 258, 289 and 303 | 85, 121, 130, 134, 154, 225, 229, 258, 289 and 336 | 85, 121, 130, 134, 154, 225, 229, 258, 303 and 336 | 85, 121, 130, 134, 154, 225, 229, 289, 303 and 336 |
| 85, 121, 130, 134, 154, 225, 258, 289, 303 and 336 | 85, 121, 130, 134, 154, 229, 258, 289, 303 and 336 | 85, 121, 130, 134, 190, 225, 229, 258, 289 and 303 | 85, 121, 130, 134, 190, 225, 229, 258, 289 and 336 | 85, 121, 130, 134, 190, 225, 229, 258, 303 and 336 |
| 85, 121, 130, 134, 190, 225, 229, 289, 303 and 336 | 85, 121, 130, 134, 190, 225, 258, 289, 303 and 336 | 85, 121, 130, 134, 190, 229, 258, 289, 303 and 336 | 85, 121, 130, 134, 225, 229, 258, 289, 303 and 336 | 85, 121, 130, 154, 190, 225, 229, 258, 289 and 303 |
| 85, 121, 130, 154, 190, 225, 229, 258, 289 and 336 | 85, 121, 130, 154, 190, 225, 229, 258, 303 and 336 | 85, 121, 130, 154, 190, 225, 229, 289, 303 and 336 | 85, 121, 130, 154, 190, 225, 258, 289, 303 and 336 | 85, 121, 130, 154, 190, 229, 258, 289, 303 and 336 |
| 85, 121, 130, 154, 225, 229, 258, 289, 303 and 336 | 85, 121, 130, 190, 225, 229, 258, 289, 303 and 336 | 85, 121, 134, 154, 190, 225, 229, 258, 289 and 303 | 85, 121, 134, 154, 190, 225, 229, 258, 289 and 336 | 85, 121, 134, 154, 190, 225, 229, 258, 303 and 336 |
| 85, 121, 134, 154, 190, 225, 229, 289, 303 and 336 | 85, 121, 134, 154, 190, 225, 258, 289, 303 and 336 | 85, 121, 134, 154, 190, 229, 258, 289, 303 and 336 | 85, 121, 134, 154, 225, 229, 258, 289, 303 and 336 | 85, 121, 134, 190, 225, 229, 258, 289, 303 and 336 |
| 85, 121, 154, 190, 225, 229, 258, 289, 303 and 336 | 85, 130, 134, 154, 190, 225, 229, 258, 289 and 303 | 85, 130, 134, 154, 190, 225, 229, 258, 289 and 336 | 85, 130, 134, 154, 190, 225, 229, 258, 303 and 336 | 85, 130, 134, 154, 190, 225, 229, 289, 303 and 336 |
| 85, 130, 134, 154, 190, 225, 258, 289, 303 and 336 | 85, 130, 134, 154, 190, 229, 258, 289, 303 and 336 | 85, 130, 134, 154, 225, 229, 258, 289, 303 and 336 | 85, 130, 134, 190, 225, 229, 258, 289, 303 and 336 | 85, 130, 154, 190, 225, 229, 258, 289, 303 and 336 |
| 85, 134, 154, 190, 225, 229, 258, 289, 303 and 336 | 121, 130, 134, 154, 190, 225, 229, 258, 289 and 303 | 121, 130, 134, 154, 190, 225, 229, 258, 289 and 336 | 121, 130, 134, 154, 190, 225, 229, 258, 303 and 336 | 121, 130, 134, 154, 190, 225, 229, 289, 303 and 336 |
| 121, 130, 134, 154, 190, 225, 258, 289, 303 and 336 | 121, 130, 134, 154, 190, 229, 258, 289, 303 and 336 | 121, 130, 134, 154, 225, 229, 258, 289, 303 and 336 | 121, 130, 134, 190, 225, 229, 258, 289, 303 and 336 | 121, 130, 154, 190, 225, 229, 258, 289, 303 and 336 |
| 121, 134, 154, 190, 225, 229, 258, 289, 303 and 336 | 130, 134, 154, 190, 225, 229, 258, 289, 303 and 336 | 85, 121, 130, 134, 154, 190, 225, 229, 258, 289 and 303 | 85, 121, 130, 134, 154, 190, 225, 229, 258, 289 and 336 | 85, 121, 130, 134, 154, 190, 225, 229, 258, 303 and 336 |
| 85, 121, 130, 134, 154, 190, 225, 229, 289, 303 and 336 | 85, 121, 130, 134, 154, 190, 225, 258, 289, 303 and 336 | 85, 121, 130, 134, 154, 190, 229, 258, 289, 303 and 336 | 85, 121, 130, 134, 154, 225, 229, 258, 289, 303 and 336 | 85, 121, 130, 134, 190, 225, 229, 258, 289, 303 and 336 |
| 85, 121, 130, 154, 190, 225, 229, 258, 289, 303 and 336 | 85, 121, 134, 154, 190, 225, 229, 258, 289, 303 and 336 | 85, 130, 134, 154, 190, 225, 229, 258, 289, 303 and 336 | 121, 130, 134, 154, 190, 225, 229, 258, 289, 303 and 336 | 85, 121, 130, 134, 154, 190, 225, 229, 258, 289, 303 and 336 |
| 60, 64, 69, 112, 115, 116, 119, 120, 145, | 60, 61, 63, 64, 69, 74, 76, 85, 112, 115, | | | |

TABLE 20-continued

Non-limiting examples of positions that may comprise a mutation, or a set of mutations [as compared to SEQ ID NO: 35]

| | |
|---|---|
| 146, 198, 223, 231, 241, 251, 273, 274, 278, 303, 314, and 334 | 116, 119, 120, 121, 130, 134, 145, 146, 154, 190, 198, 223, 225, 227, 229, 231, 241, 251, 258, 273, 274, 278, 289, 303, 314, 334, and 336 |

In some embodiments, the polypeptide comprises a mutation as compared to SEQ ID NO: 35. In some embodiments, the mutation is a substitution, a deletion, or an insertion. In some embodiments, the mutation is a substitution. Non-limiting examples of mutations, as compared to SEQ ID NO: 35, are provided in Table 21 below.

In some embodiments, the polypeptide comprises any mutation provided in Table 21, as compared to SEQ ID NO: 35. In some embodiments, the polypeptide comprises any set of mutations provided in Table 21, as compared to SEQ ID NO: 35. In some embodiments, the polypeptide comprises an amino acid sequence having any mutation provided in Table 21, as compared to SEQ ID NO: 35. In some embodiments, the polypeptide comprises an amino acid sequence having any set of mutations provided in Table 21, as compared to SEQ ID NO: 35. In some embodiments, the polypeptide comprises the amino acid sequence having at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 35, provided that the amino acid sequence comprises any mutation, or any set of mutations, provided in Table 21, as compared to SEQ ID NO: 35.

In some embodiments, a polypeptide comprises an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 35, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35. In some embodiments, a polypeptide comprises an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336, as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations at positions 60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations at positions 60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

In some embodiments, the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35. In some embodiments, the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, 336 as compared to SEQ ID NO: 35. In some embodiments, the polypeptide comprises the set of mutations at positions 60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35. In some embodiments, the polypeptide comprises the set of mutations at positions 60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35. In some embodiments, the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35. In some embodiments, a molecule comprises an Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1, provided that the Fc polypeptide comprises a mutation, or a set of mutations at any one position, or any combination of positions selected from 234, 235, 237, 296, and 329 as compared to SEQ ID NO: 1; and a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 35, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35, wherein the polypeptide is linked or conjugated to N- or C-terminus of the Fc polypeptide.

In some embodiments, a molecule comprises an Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1; and a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35, wherein the polypeptide is linked or conjugated to N- or C-terminus of the Fc polypeptide.

In some embodiments, a molecule comprises an Fc polypeptide having an amino acid sequence of SEQ ID NO: 23; and a polypeptide having an amino acid sequence of any one of SEQ ID NOs: 1290, 1295, 1301, 1303, or 1310, wherein the polypeptide is linked or conjugated to N- or C-terminus of the Fc polypeptide.

In some embodiments, a molecule comprises, from N- to C-terminus, the Fc polypeptide having an amino acid sequence of SEQ ID NO: 23, and the polypeptide having an amino acid sequence of SEQ ID NO: 1290. In some embodiments, a molecule comprises, from N- to C-terminus, the Fc polypeptide having an amino acid sequence of SEQ ID NO: 23, and the polypeptide having an amino acid sequence of SEQ ID NO: 1295. In some embodiments, a molecule comprises, from N- to C-terminus, the Fc polypeptide having an amino acid sequence of SEQ ID NO: 23, and the polypeptide having an amino acid sequence of SEQ ID NO: 1301. In some embodiments, a molecule comprises, from N- to C-terminus, the Fc polypeptide having an amino acid sequence of SEQ ID NO: 23, and the polypeptide having an amino acid sequence of SEQ ID NO: 1303. In some embodiments, a molecule comprises, from N- to C-terminus, the Fc polypeptide having an amino acid sequence of SEQ ID NO: 23, and the polypeptide having an amino acid sequence of SEQ ID NO: 1310. In some embodiments, a molecule comprises, from N- to C-terminus, the polypeptide having an amino acid sequence of SEQ ID NO: 1290, and the Fc polypeptide having an amino acid sequence of SEQ ID NO: 23. In some embodiments, a molecule comprises, from N- to C-terminus, the polypeptide having an amino acid sequence of SEQ ID NO: 1295, and the Fc polypeptide having an amino acid sequence of SEQ ID NO: 23. In some embodiments, a molecule comprises, from N- to C-terminus, the polypeptide having an amino acid sequence of SEQ ID NO: 1301, and the Fc polypeptide having an amino acid sequence of SEQ ID NO: 23. In some embodiments, a molecule comprises, from N- to C-terminus, the polypeptide having an amino acid sequence of SEQ ID NO: 1303, and the Fc polypeptide having an amino acid sequence of SEQ ID NO: 23. In some embodiments, a molecule comprises, from N- to C-terminus, the polypeptide having an amino acid sequence of SEQ ID NO: 1310, and the Fc polypeptide having an amino acid sequence of SEQ ID NO: 23.

In some embodiments, any one mutation, or set of mutations, selected from A60T, N61D, T63I, Q64K, Q64Y, F69L, V74K, N76G, D112E, K115E, R116N, E119K, E120K, N145D, H146S, E198R, S223N, F227L, E229N, N231T, K241Q, L251I, S273A, N274E, K278E, A303N, K314E, and S334I, as compared to SEQ ID NO: 35, increases stability of the polypeptide, and reduces, or prevents anti-drug antibody binding to the polypeptide. In some embodiments, the polypeptide comprising any one, or any set, of mutations selected from A60T, N61D, T63I, Q64K, Q64Y, F69L, V74K, N76G, D112E, K115E, R116N, E119K, E120K, N145D, H146S, E198R, S223N, F227L, E229N, N231T, K241Q, L251I, S273A, N274E, K278E, A303N, K314E, and S334I, as compared to SEQ ID NO: 35, has increased stability, and/or reduced, or no binding to an anti-drug antibody.

In some embodiments, the polypeptide comprises a mutation or a set of mutations selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35. In some embodiments, the polypeptide comprises a set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35. In some embodiments, the polypeptide comprises a set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35. In some embodiments, the polypeptide comprises a set of mutations of A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35. In some embodiments, the polypeptide comprises a set of mutations of A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35. In some embodiments, the polypeptide comprises a set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations of A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E K278E, D286N, A289P, A303S, K314E, S334I, and N336Q as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations of A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35. In some embodiments, the polypeptide comprises the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

In some embodiments, a polypeptide comprises an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 1303, 1290, 1291, 1292, 1293, 1294, 1295, 1296, 1297, 1298, 1299, 1300, 1301, 1302, 1304, 1305, 1306, 1307, 1308, 1309, 1310, and 1333, provided that the polypeptide comprises any one of, or any combination of, a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, an asparagine (N) at position 286, a proline (P) at position 289, a serine (S) at position 303, a glutamic acid (E) at position 314, an isoleucine (I) at position 334, and glutamine (Q) at position 336, as compared to SEQ ID NO: 35.

In some embodiments, a polypeptide comprises an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, as compared to SEQ ID NO: 35.

As used herein, the language "corresponds to a position," "compared to" a reference sequence or similar language means when the two sequences are aligned the residues line up. For example, FIG. 9 illustrates the alignment of a non-limiting polypeptide (e.g., SEQ ID NO: 1303) provided for herein to SEQ ID NO: 35 to illustrate how the positions correspond to/align with those in SEQ ID NO: 35. The alignment was done with clustal omega and default settings. Clustal omega can be accessed, for example, at www"dot"ebi"dot"ac"dot"uk/Tools/msa/clustalo/. Thus, in some embodiments, the mutations A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q, are as compared to SEQ ID NO: 35, which is the amino acid of wild-type full length IdeS. In some embodiments, the mutations are as compared to the polypeptides disclosed herein, which may be variants and/or truncations of the wild-type full-length IdeS having the amino acid sequence of SEQ ID NO: 35. In some embodiments, the mutations A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q, as compared to SEQ ID NO: 35, may be provided as A13T, N14T, T16I, Q17Y, F22L, V27K, N29G, T38L, D65E, K68E, R69N, E72K, E73K, H74Y, N83K, N83G, M87L, N98D, H99S, E107D, N143D, E151R, S176N, H178Y, F180L, N184T, K194Q, L204I, V211G, N214G, S226A, N227E, K231E, D239N, A242P, A256S, K267E, S287I, and N289Q, as compared to, for example, SEQ ID NO: 1303, respectively. Thus, in some embodiments, a polypeptide comprises an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations of A13T, N14T, T16I, Q17Y, F22L, V27K, N29G, T38L, D65E, K68E, R69N, E72K, E73K, H74Y, N83K, N83G, M87L, N98D, H99S, E107D, N143D, E151R, S176N, H178Y, F180L, N184T, K194Q, L204I, V211G, N214G, S226A, N227E, K231E, D239N, A242P, A256S, K267E, S287I, and N289Q, as compared to, SEQ ID NO: 1303.

In some embodiments, a polypeptide comprises an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises a threonine (T) at position 13, an aspartic acid (D) at position 14, an isoleucine (I) at position 16, a tyrosine (Y) at position 17, a leucine (L) at position 22, a lysine (K) at position 27, a glycine (G) at position 29, a leucine (L) at position 38, a glutamic acid (E) at position 65, an asparagine (N) at position 69, a lysine (K) at position 72, a lysine (K) at position 73, a tyrosine (Y) at position 74, a glycine (G) at position 83, a leucine (L) at position 87, an aspartic acid (D) at position 98, a serine (S) at position 99, an aspartic acid (D) at position 107, an aspartic acid (D) at position 143, an arginine (R) at position 151, an asparagine (N) at position 176, a tyrosine (Y) at position 178, a leucine (L) at position 180, a threonine (T) at position 184, a glutamine (Q) at position 194, an isoleucine (I) at position 204, a glycine (G) at position 214, an alanine (A) at position 226, a glutamic acid (E) at position 227, a glutamic acid (E) at position 231, a proline (P) at position 242, a serine (S) at position 256, a glutamic acid (E) at position 267, and an isoleucine (I) at position 287, as compared to SEQ ID NO: 1303.

In some embodiments, a polypeptide comprises an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 1290, 1291, 1292, 1293, 1294, 1295, 1296, 1297, 1298, 1299, 1300, 1301, 1302, 1304, 1305, 1306, 1307, 1308, 1309, 1310, and 1333, provided that the polypeptide comprises any one of sets selected from: a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 258, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, an asparagine (N) at position 286, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, as compared to SEQ ID NO: 35; or a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336 as compared to SEQ ID NO: 35.

In some embodiments, a polypeptide comprises any one of sets selected from: a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 258, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, an asparagine (N) at position 286, a proline (P) at position 289, a serine (S) at position 303, a glutamic acid (E) at position 314, an isoleucine (I) at position 334, and a glutamine (Q) at position 336, as compared to SEQ ID NO: 35; a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, as compared to SEQ ID NO: 35; or a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336 as compared to SEQ ID NO: 35.

In some embodiments, a polypeptide is provided that is at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% identical to a polypeptide comprising the amino acid sequence of SEQ ID NO: 36 or 1349, provided that the polypeptide comprises one or more of, or all of the following: a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, wherein the positions correspond to the positions as in SEQ ID NO: 35. In some embodiments, the polypeptide is at least 80% identical to a polypeptide comprising the amino acid sequence of SEQ ID NO: 36 or 1349, with the provisos described in this paragraph. In some embodiments, the polypeptide is at least 81% identical to a polypeptide comprising the amino acid sequence of SEQ ID NO: 36 or 1349, with the provisos described in this paragraph. In some embodiments, the polypeptide is at least 82% identical to a polypeptide comprising the amino acid sequence of SEQ ID NO: 36 or 1349, with the provisos described in this paragraph. In some embodiments, the polypeptide is at least 83% identical to a polypeptide comprising the amino acid sequence of SEQ ID NO: 36 or 1349, with the provisos described in this paragraph. In some embodiments, the polypeptide is at least 84% identical to a polypeptide comprising the amino acid sequence of SEQ ID NO: 36 or 1349, with the provisos described in this paragraph. In some embodiments, the polypeptide is at least 85% identical to a polypeptide comprising the amino acid sequence of SEQ ID NO: 36 or 1349, with the provisos described in this paragraph. In some embodiments, the polypeptide is at least 86% identical to a polypeptide comprising the amino acid sequence of SEQ ID NO: 36 or 1349, with the provisos described in this paragraph. In some embodiments, the polypeptide is at least 87% identical to a polypeptide comprising the amino acid sequence of SEQ ID NO: 36 or 1349, with the provisos described in this paragraph. In some embodiments, the polypeptide is at least 88% identical to a polypeptide comprising the amino acid sequence of SEQ ID NO: 36 or 1349, with the provisos described in this paragraph. In some embodiments, the polypeptide is at least 89% identical to a polypeptide comprising the amino acid sequence of SEQ ID NO: 36 or 1349, with the provisos described in this paragraph. In some embodiments, the polypeptide is at least 90% identical to a polypeptide comprising the amino acid sequence of SEQ ID NO: 36 or 1349, with the provisos described in this paragraph. In some embodiments, the polypeptide does not comprises the amino acid sequence of DSFSANQEIRYSEVTPYHVT (SEQ ID NO: 1351). In some embodiments, the polypeptide does not include the amino acid sequence of DSFSANQEIRYSEVTPYHVT (SEQ ID NO: 1351). In some embodiments, the polypeptide does not include the contiguous amino acid sequence of DSFSANQEIRYSEVTPYHVT (SEQ ID NO: 1351) in its entirety. In some embodiments, the polypeptide does not include the contiguous amino acid sequence of DSFSANQEIRYSEVTPYHVT (SEQ ID NO: 1351) in its entirety, or the dipeptide of VT at the N-terminus of the polypeptide. As used herein, the N-terminus of the polypeptide in reference to the contiguous amino acid sequence of DSFSANQEIRYSEVTPYHVT (SEQ ID NO: 1351), or the dipeptide of VT means the N-terminus of the protease, which may be C-terminal to a linker or another polypeptide if the protease is linked to another polypeptide, such as the Fc domains provided for herein. In some embodiments, the polypeptide does not include the dipeptide of VT at the N-terminus of the polypeptide. In some embodiments, the polypeptide does not comprises the amino acid sequence of DSFSANQEIRYSEVTPYH (SEQ ID NO: 1352). In some embodiments, the polypeptide does not comprises the amino acid sequence of ANQEIRYSEVTPYHVT (SEQ ID NO: 1353). In some embodiments, the polypeptide does not comprises the amino acid sequence of ANQEIRYSEVTPYH (SEQ ID NO: 1354). In some embodiments, the polypeptide does not comprise the amino acid sequence of NQTN (SEQ ID NO: 1355). In some embodiments, the polypeptide does not comprise the contiguous amino acid sequence of NQTN (SEQ ID NO: 1355). In some embodiments, the polypeptide does not comprise the contiguous amino acid sequence of NQTN (SEQ ID NO: 1355) at the C-terminus of the polypeptide. As used herein, the C-terminus of the polypeptide in reference to the contiguous amino acid sequence of NQTN (SEQ ID NO: 1355) means the C-terminus of the protease, which may be N-terminal to a linker or another polypeptide if the protease is linked to another polypeptide, such as the Fc domains provided for herein. In some embodiments, the polypeptide comprises the sequence of QQTN (SEQ ID NO: 1356) at the C-terminus of the polypeptide instead of the sequence of NQTN (SEQ ID NO: 1355).

In some embodiments, the polypeptide has a cysteine (C) at the position in said polypeptide which corresponds to position 94 of SEQ ID NO: 35. In some embodiments, the polypeptide has, at the positions in said variant sequence which correspond to positions 84, 262, 284 and 286 of SEQ ID NO: 35, a lysine (K), a histidine (H), an aspartic acid (D) and an aspartic acid (D), respectively. In some embodiments, the polypeptide has Ig protease activity. In some embodiments, the polypeptide has IgG protease activity. In some embodiments, the polypeptide is wherein is less immunogenic than an IdeS polypeptide, such as an IdeS polypeptide that comprises the amino acid sequence of SEQ ID NO: 35, SEQ ID NO: 36 or SEQ ID NO: 1349. In some embodiments, the polypeptide produces greater quantity of IgG cleavage fragments than IdeS (e.g., SEQ ID NO: 35, SEQ ID NO: 36, or SEQ ID NO: 1349). In some embodiments, the polypeptide has a positively charged amino acid at the position in said variant which corresponds to position 130 of SEQ ID NO: 35, such as, arginine (R) or lysine (K). In some embodiments, the polypeptide has a positively charged amino acid at the position in said variant which corresponds to position 131 of SEQ ID NO: 35, such as arginine (R) or lysine (K).

In some embodiments, the polypeptide is linked to a protease resistant Fc domain. In some embodiments, the protease resistant Fc domain is linked to the N-terminus or the C-terminus of the polypeptide. In some embodiments, the protease resistant Fc domain is linked to the N-terminus of the polypeptide. In some embodiments, the protease resistant Fc domain is linked to the C-terminus of the polypeptide. In some embodiments, the protease resistant Fc domain is linked to the polypeptide through a linker. In some embodiments, the protease resistant Fc domain is linked to the polypeptide through a peptide linker. In some embodiments, the peptide linker is a charged peptide linker. As used herein, "charged peptide linker" is meant to refer to a peptide linker having at least one positively charged amino acid residue, such as, but not limited to, a lysine (K), an arginine (R), or a histidine (H). In some embodiments, the peptide linker comprises the amino acid sequence of SEQ ID NO: 1330. In some embodiments, the protease resistant Fc domain is as provided for herein. In some embodiments, the protease resistant Fc domain comprises the amino acid sequence of any one of SEQ ID NOs: 19, 20, 21, 22, 23, 24, 25, 42, 43, 44, 45, 46, 47, 48, or 49. In some embodiments, the protease resistant Fc domain comprises the amino acid sequence of SEQ ID NO: 23. In some embodiments, the polypeptide comprises from N-terminus to C-terminus a protease resistant Fc domain, a peptide linker, and a polypeptide, wherein the C-terminus of the protease resistant Fc domain is linked to the N-terminus of the peptide linker and the C-terminus of the peptide linker is linked to the N-terminus of the polypeptide.

In some embodiments, the polypeptide comprises the amino acid sequence as set forth in Table 7 in the column labeled "Full length sequence" of VRT-1 through VRT-319. In some embodiments, the polypeptide has Ig protease activity, such as IgG protease activity. In some embodiments, the polypeptide is less immunogenic than an IdeS polypeptide, wherein the IdeS polypeptide optionally comprises the amino acid sequence of SEQ ID NO: 35, SEQ ID NO: 36 or SEQ ID NO: 1349. In some embodiments, the polypeptide produces greater quantity of IgG cleavage fragments than IdeS (e.g., SEQ ID NO: 35, SEQ ID NO: 36, or SEQ ID NO: 1349). In some embodiments, the polypeptide of SEQ ID NO: 1349 produces greater quantity of IgG cleavage fragments than IdeS.

In some embodiments, a mutation of H225Y, as compared to SEQ ID NO: 35, increases expression of the polypeptide. In some embodiments, the polypeptide comprising a mutation of H225Y, as compared to SEQ ID NO: 35, has increased expression. In some embodiments, any one mutation, or set of mutations, selected from T85L, H121Y, E154D, N190D, A289P, and N303S, as compared to SEQ ID NO: 35, removes the T-cell binding epitope. In some embodiments, any one mutation, or set of mutations, selected from T85L, H121Y, E154D, N190D, A289P, and N303S, as compared to SEQ ID NO: 35, reduces, or prevents T-cell binding to the polypeptide. In some embodiments, the polypeptide comprising any one, or any set, of mutations selected from T85L, H121Y, E154D, N190D, A289P, and N303S, as compared to SEQ ID NO: 35, has no T-cell binding epitope. In some embodiments, the polypeptide comprising any one, or any set, of mutations selected from T85L, H121Y, E154D, N190D, A289P, and N303S, as compared to SEQ ID NO: 35, does not bind to a T-cell. In some embodiments, any one mutation, or set of mutations, selected from T85L, H121Y, E154D, N190D, A289P, and N303S, as compared to SEQ ID NO: 35, removes the T-cell binding epitope. In some embodiments, any one mutation, or set of mutations, selected from T85L, H121Y, E154D, N190D, A289P, and N303S, as compared to SEQ ID NO: 35, reduces, or prevents T-cell binding to the polypeptide. In some embodiments, the polypeptide comprising any one, or any set, of mutations selected from T85L, H121Y, E154D, N190D, V258G, A289P, and N303S, as compared to SEQ ID NO: 35, has no T-cell binding epitope. In some embodiments, the polypeptide comprising any one, or any set, of mutations selected from T85L, H121Y, E154D, N190D, V258G, A289P, and N303S, as compared to SEQ ID NO: 35, does not bind to a T-cell.

In some embodiments, any one mutation, or set of mutations, selected from M134L, N190D, N229E, A289P, and N336Q, as compared to SEQ ID NO: 35, removes the chemical liabilities. In some embodiments, the polypeptide comprising any one, or any set, of mutations selected from M134L, N190D, N229E, A289P, and N336Q, as compared to SEQ ID NO: 35, has no chemical liabilities. In some embodiments, any one mutation, or set of mutations, selected from N130K, M134L, N190D, N229E, A289P, and N336Q, as compared to SEQ ID NO: 35, removes the chemical liabilities. In some embodiments, the polypeptide comprising any one, or any set, of mutations selected from N130K, M134L, N190D, N229E, A289P, and N336Q, as compared to SEQ ID NO: 35, has no chemical liabilities.

In some embodiments, any one mutation, or set of mutations, selected from T85L, H121Y, N130K, M134L, E154D, N190D, N229E, A289P, N303S, and N336Q, as compared to SEQ ID NO: 35, increases stability of the polypeptide, reduces, or prevents anti-drug antibody binding to the polypeptide, removes the T-cell binding epitope, and removes the chemical liabilities. In some embodiments, any one mutation, or set of mutations, selected from T85L, H121Y, N130K, M134L, E154D, N190D, N229E, A289P, N303S, and N336Q, as compared to SEQ ID NO: 35, increases stability of the polypeptide, reduces, or prevents anti-drug antibody binding to the polypeptide, reduces, or prevents T-cell binding to the polypeptide, and/or removes the chemical liabilities. In some embodiments, the polypeptide comprising any one, or any set, of mutations selected from T85L, H121Y, N130K, M134L, E154D, N190D, N229E, A289P, N303S, and N336Q, as compared to SEQ ID NO: 35, has increased stability, reduced, or no binding to an anti-drug antibody, no T-cell binding epitope, and/or no chemical liabilities. In some embodiments, the polypeptide comprising any one, or any set, of mutations selected from T85L, H121Y, N130K, M134L, E154D, N190D, N229E, A289P, N303S, and N336Q, as compared to SEQ ID NO: 35, has increased stability, reduced, or no binding to an anti-drug antibody, does not bind to a T-cell, and/or has no chemical liabilities.

In some embodiments, any one mutation, or set of mutations, selected from T85L, H121Y, M134L, E154D, N190D, N229E, A289P, N303S, and N336Q, as compared to SEQ ID NO: 35, increases stability of the polypeptide, reduces, or prevents anti-drug antibody binding to the polypeptide, removes the T-cell binding epitope, and removes the chemical liabilities. In some embodiments, any one mutation, or set of mutations, selected from T85L, H121Y, M134L, E154D, N190D, N229E, A289P, N303S, and N336Q, as compared to SEQ ID NO: 35, increases stability of the polypeptide, reduces, or prevents anti-drug antibody binding to the polypeptide, reduces, or prevents T-cell binding to the polypeptide, and/or removes the chemical liabilities. In some embodiments, the polypeptide comprising any one, or any set, of mutations selected from T85L, H121Y, M134L, E154D, N190D, N229E, A289P, N303S, and N336Q, as compared to SEQ ID NO: 35, has increased stability, reduced, or no binding to an anti-drug antibody, no T-cell binding epitope, and/or no chemical liabilities. In some embodiments, the polypeptide comprising any one, or any set, of mutations selected from T85L, H121Y, M134L, E154D, N190D, N229E, A289P, N303S, and N336Q, as compared to SEQ ID NO: 35, has increased stability, reduced, or no binding to an anti-drug antibody, does not bind to a T-cell, and/or has no chemical liabilities. In some embodiments, any one mutation, or set of mutations, selected from T85L, H121Y, N130K, M134L, E154D, N190D, N229E, V258G, A289P, N303S, and N336Q, as compared to SEQ ID NO: 35, increases stability of the polypeptide, reduces, or prevents anti-drug antibody binding to the polypeptide, removes the T-cell binding epitope, and removes the chemical liabilities. In some embodiments, any one mutation, or set of mutations, selected from T85L, H121Y, N130K, M134L, E154D, N190D, N229E, V258G, A289P, N303S, and N336Q, as compared to SEQ ID NO: 35, increases stability of the polypeptide, reduces, or prevents anti-drug antibody binding to the polypeptide, reduces, or prevents T-cell binding to the polypeptide, and/or removes the chemical liabilities. In some embodiments, the polypeptide comprising any one, or any set, of mutations selected from T85L, H121Y, N130K, M134L, E154D, N190D, N229E, V258G, A289P, N303S, and N336Q, as compared to SEQ ID NO: 35, has increased stability, reduced, or no binding to an anti-drug antibody, no T-cell binding epitope, and/or no chemical liabilities. In some embodiments, the polypeptide comprising any one, or any set, of mutations selected from T85L, H121Y, N130K, M134L, E154D, N190D, N229E, V258G, A289P, N303S, and N336Q, as compared to SEQ ID NO: 35, has increased stability, reduced, or no binding to an anti-drug antibody, does not bind to a T-cell, and/or has no chemical liabilities. In some embodiments, any one mutation, or set of mutations, selected from T85L, H121Y, M134L, E154D, N190D, N229E, V258G, A289P, N303S, and N336Q, as compared to SEQ ID NO: 35, increases stability of the polypeptide, reduces, or prevents anti-drug antibody binding to the polypeptide, removes the T-cell binding epitope, and removes the chemical liabilities. In some embodiments, any one mutation, or set of mutations, selected from T85L, H121Y, M134L, E154D, N190D, N229E, V258G, A289P, N303S, and N336Q, as compared to SEQ ID NO: 35, increases stability of the polypeptide, reduces, or prevents anti-drug antibody binding to the polypeptide, reduces, or prevents T-cell binding to the polypeptide, and/or removes the chemical liabilities. In some embodiments, the polypeptide comprising any one, or any set, of mutations selected from T85L, H121Y, M134L, E154D, N190D, N229E, V258G, A289P, N303S, and N336Q, as compared to SEQ ID NO: 35, has increased stability, reduced, or no binding to an anti-drug antibody, no T-cell binding epitope, and/or no chemical liabilities. In some embodiments, the polypeptide comprising any one, or any set of mutations selected from T85L, H121Y, M134L, E154D, N190D, N229E, V258G, A289P, N303S, and N336Q, as compared to SEQ ID NO: 35, has increased stability, reduced, or no binding to an anti-drug antibody, does not bind to a T-cell, and/or has no chemical liabilities.

TABLE 21

Non-limiting examples of mutations [as compared to SEQ ID NO: 35]

| | | | | |
|---|---|---|---|---|
| A60T | N61D | T63I | Q64K | V74K |
| N76G | H146S | F227L | E229NT85L | H121Y |
| N130K | M134L | E154D | N190D | H225Y |
| N229E | V258G | A289P | N303S | N336Q |
| T85L and H121Y | T85L and N130K | T85L and M134L | T85L and E154D | T85L and N190D |
| T85L and N229E | T85L and H225Y | T85L and V258G | T85L and A289P | T85L and N303S |
| T85L and N336Q | H121Y and N130K | H121Y and M134L | H121Y and E154D | H121Y and N190D |
| H121Y and H225Y | H121Y and N229E | H121Y and V258G | H121Y and A289P | H121Y and N303S |
| H121Y and N336Q | N130K and M134L | N130K and E154D | N130K and N190D | N130K and H225Y |
| N130K and N229E | N130K and A289P | N130K and N303S | N130K and N336Q | |
| M134L and E154D | M134L and N190D | M134L and H225Y | M134L and N229E | M134L and V258G |
| M134L and A289P | M134L and N303S | M134L and N336Q | E154D and N190D | E154D and H225Y |
| E154D and N229E | E154D and V258G | E154D and A289P | E154D and N303S | E154D and N336Q |
| N190D and H225Y | N190D and N229E | N190D and V258G | N190D and A289P | N190D and N303S |
| N190D and N336Q | H225Y and N229E | H225Y and V258G | H225Y and A289P | H225Y and N303S |

TABLE 21-continued

Non-limiting examples of mutations [as compared to SEQ ID NO: 35]

| | | | | |
|---|---|---|---|---|
| H225Y and N336Q | N229E and V258G | N229E and A289P | N229E and N303S | N229E and N336Q |
| V258G and A289P | V258G and N303S | V258G and N336Q | A289P and N303S | A289P and N336Q |
| N303S and N336Q | A60T and N61D | A60T and T63I | A60T and Q64K | A60T and V74K |
| A60T and N76G | A60T and H146S | A60T and F227L | A60T and E229N | N61D and T63I |
| N61D and Q64K | N61D and V74K | N61D and N76G | N61D and H146S | N61D and F227L |
| N61D and E229N | T63I and Q64K | T63I and V74K | T63I and N76G | T63I and H146S |
| T63I and F227L | T63I and E229N | Q64K and V74K | Q64K and N76G | Q64K and H146S |
| Q64K and F227L | Q64K and E229N | V74K and N76G | V74K and H146S | V74K and F227L |
| V74K and E229N | N76G and H146S | N76G and F227L | N76G and E229N | H146S and F227L |
| H146S and E229N | F227L and E229N | A60T, N61D and T63I | A60T, N61D and Q64K | A60T, N61D and V74K |
| A60T, N61D and N76G | A60T, N61D and H146S | A60T, N61D and F227L | A60T, N61D and E229N | A60T, T63I and Q64K |
| A60T, T63I and V74K | A60T, T63I and N76G | A60T, T63I and H146S | A60T, T63I and F227L | A60T, T63I and E229N |
| A60T, Q64K and V74K | A60T, Q64K and N76G | A60T, Q64K and H146S | A60T, Q64K and F227L | A60T, Q64K and E229N |
| A60T, V74K and N76G | A60T, V74K and H146S | A60T, V74K and F227L | A60T, V74K and E229N | A60T, N76G and H146S |
| A60T, N76G and F227L | A60T, H146S and F227L | A60T, H146S and E229N | A60T, F227L and E229N | A60T, N76G and E229N |
| N61D, T63I and Q64K | N61D, T63I and V74K | N61D, T63I and N76G | N61D, T63I and H146S | N61D, T63I and F227L |
| N61D, T63I and E229N | N61D, Q64K and V74K | N61D, Q64K and N76G | N61D, Q64K and H146S | N61D, Q64K and F227L |
| N61D, Q64K and E229N | N61D, V74K and N76G | N61D, V74K and H146S | N61D, V74K and F227L | N61D, V74K and E229N |
| N61D, N76G and H146S | N61D, N76G and F227L | N61D, N76G and E229N | N61D, H146S and F227L | N61D, H146S and E229N |
| N61D, F227L and E229N | T63I, Q64K and V74K | T63I, Q64K and N76G | T63I, Q64K and H146S | T63I, Q64K and F227L |
| T63I, Q64K and E229N | T63I, V74K and N76G | T63I, V74K and H146S | T63I, V74K and F227L | T63I, V74K and E229N |
| T63I, N76G and H146S | T63I, N76G and F227L | T63I, N76G and E229N | T63I, H146S and F227L | T63I, H146S and E229N |
| T63I, F227L and E229N | Q64K, V74K and N76G | Q64K, V74K and H146S | Q64K, V74K and F227L | Q64K, V74K and E229N |
| Q64K, N76G and H146S | Q64K, N76G and F227L | Q64K, N76G and E229N | Q64K, H146S and F227L | Q64K, H146S and E229N |
| Q64K, F227L and E229N | V74K, N76G and H146S | V74K, N76G and F227L | V74K, N76G and E229N | V74K, H146S and F227L |
| V74K, H146S and E229N | V74K, F227L and E229N | N76G, H146S and F227L | N76G, H146S and E229N | N76G, F227L and E229N |
| H146S, F227L and E229NT85L, H121Y and N130K | T85L, H121Y and M134L | T85L, H121Y and E154D | T85L, H121Y and N190D | T85L, H121Y and H225Y |
| T85L, H121Y and N229E | T85L, H121Y and V258G | T85L, H121Y and A289P | T85L, H121Y and N303S | T85L, H121Y and N336Q |
| T85L, N130K and M134L | T85L, N130K and E154D | T85L, N130K and N190D | T85L, N130K and H225Y | T85L, N130K and N229E |
| T85L, N130K and V258G | T85L, N130K and A289P | T85L, N130K and N303S | T85L, N130K and N336Q | T85L, M134L and E154D |
| T85L, M134L and N190D | T85L, M134L and H225Y | T85L, M134L and N229E | T85L, M134L and V258G | T85L, M134L and A289P |
| T85L, M134L and N303S | T85L, M134L and N336Q | T85L, E154D and N190D | T85L, E154D and H225Y | T85L, E154D and N229E |
| T85L, E154D and V258G | T85L, E154D and A289P | T85L, E154D and N303S | T85L, E154D and N336Q | T85L, N190D and H225Y |
| T85L, N190D and N229E | T85L, N190D and V258G | T85L, N190D and A289P | T85L, N190D and N303S | T85L, N190D and N336Q |
| T85L, H225Y and N229E | T85L, H225Y and V258G | T85L, H225Y and A289P | T85L, H225Y and N303S | T85L, H225Y and N336Q |
| T85L, N229E and V258G | T85L, N229E and A289P | T85L, N229E and N303S | T85L, N229E and N336Q | T85L, V258G and A289P |
| T85L, V258G and N303S | T85L, V258G and N336Q | T85L, A289P and N303S | T85L, A289P and N336Q | T85L, N303S and N336Q |
| H121Y, N130K and M134L | H121Y, N130K and E154D | H121Y, N130K and N190D | H121Y, N130K and H225Y | H121Y, N130K and N229E |
| H121Y, N130K and V258G | H121Y, N130K and A289P | H121Y, N130K and N303S | H121Y, N130K and N336Q | H121Y, M134L and E154D |
| H121Y, M134L and N190D | H121Y, M134L and H225Y | H121Y, M134L and N229E | H121Y, M134L and V258G | H121Y, M134L and A289P |
| H121Y, M134L and N303S | H121Y, M134L and N336Q | H121Y, E154D and N190D | H121Y, E154D and H225Y | H121Y, E154D and N229E |
| H121Y, E154D and V258G | H121Y, E154D and A289P | H121Y, E154D and N303S | H121Y, E154D and N336Q | H121Y, N190D and H225Y |
| H121Y, N190D and N229E | H121Y, N190D and V258G | H121Y, N190D and A289P | H121Y, N190D and N303S | H121Y, N190D and N336Q |
| H121Y, H225Y and N229E | H121Y, H225Y and V258G | H121Y, H225Y and A289P | H121Y, H225Y and N303S | H121Y, H225Y and N336Q |
| H121Y, N229E and V258G | H121Y, N229E and A289P | H121Y, N229E and N303S | H121Y, N229E and N336Q | H121Y, V258G and A289P |
| H121Y, V258G and N303S | H121Y, V258G and N336Q | H121Y, A289P and N303S | H121Y, A289P and N336Q | H121Y, N303S and N336Q |
| N130K, M134L and E154D | N130K, M134L and N190D | N130K, M134L and H225Y | N130K, M134L and N229E | N130K, M134L and V258G |
| N130K, M134L and A289P | N130K, M134L and N303S | N130K, M134L and N336Q | N130K, E154D and N190D | N130K, E154D and H225Y |
| N130K, E154D and N229E | N130K, E154D and V258G | N130K, E154D and A289P | N130K, E154D and N303S | N130K, E154D and N336Q |
| N130K, N190D and H225Y | N130K, N190D and N229E | N130K, N190D and V258G | N130K, N190D and A289P | N130K, N190D and N303S |
| N130K, N190D and N336Q | N130K, H225Y and N229E | N130K, H225Y and V258G | N130K, H225Y and A289P | N130K, H225Y and N303S |
| N130K, H225Y and N336Q | N130K, N229E and V258G | N130K, N229E and A289P | N130K, N229E and N303S | N130K, N229E and N336Q |
| N130K, V258G and A289P | N130K, V258G and N303S | N130K, V258G and N336Q | N130K, A289P and N303S | N130K, A289P and N336Q |
| N130K, N303S and N336Q | M134L, E154D and N190D | M134L, E154D and H225Y | M134L, E154D and N229E | M134L, E154D and V258G |
| M134L, E154D and A289P | M134L, E154D and N303S | M134L, E154D and N336Q | M134L, N190D and H225Y | M134L, N190D and N229E |
| M134L, N190D and V258G | M134L, N190D and A289P | M134L, N190D and N303S | M134L, N190D and N336Q | M134L, H225Y and N229E |

TABLE 21-continued

Non-limiting examples of mutations [as compared to SEQ ID NO: 35]

| | | | | |
|---|---|---|---|---|
| M134L, H225Y and V258G | M134L, H225Y and A289P | M134L, H225Y and N303S | M134L, H225Y and N336Q | M134L, N229E and V258G |
| M134L, N229E and A289P | M134L, N229E and N303S | M134L, N229E and N336Q | M134L, V258G and A289P | M134L, V258G and N303S |
| M134L, V258G and N336Q | M134L, A289P and N303S | M134L, A289P and N336Q | M134L, N303S and N336Q | E154D, N190D and H225Y |
| E154D, N190D and N229E | E154D, N190D and V258G | E154D, N190D and A289P | E154D, N190D and N303S | E154D, N190D and N336Q |
| E154D, H225Y and N229E | E154D, H225Y and V258G | E154D, H225Y and A289P | E154D, H225Y and N303S | E154D, H225Y and N336Q |
| E154D, N229E and V258G | E154D, N229E and A289P | E154D, N229E and N303S | E154D, N229E and N336Q | E154D, V258G and A289P |
| E154D, V258G and N303S | E154D, V258G and N336Q | E154D, A289P and N303S | E154D, A289P and N336Q | E154D, N303S and N336Q |
| N190D, H225Y and N229E | N190D, H225Y and V258G | N190D, H225Y and A289P | N190D, H225Y and N303S | N190D, H225Y and N336Q |
| N190D, N229E and V258G | N190D, N229E and A289P | N190D, N229E and N303S | N190D, N229E and N336Q | N190D, V258G and A289P |
| N190D, V258G and N303S | N190D, V258G and N336Q | N190D, A289P and N303S | N190D, A289P and N336Q | N190D, N303S and N336Q |
| H225Y, N229E and V258G | H225Y, N229E and A289P | H225Y, N229E and N303S | H225Y, N229E and N336Q | H225Y, V258G and A289P |
| H225Y, V258G and N303S | H225Y, V258G and N336Q | H225Y, A289P and N303S | H225Y, A289P and N336Q | H225Y, N303S and N336Q |
| N229E, V258G and A289P | N229E, V258G and N303S | N229E, V258G and N336Q | N229E, A289P and N303S | N229E, A289P and N336Q |
| N229E, N303S and N336Q | V258G, A289P and N303S | V258G, A289P and N336Q | V258G, N303S and N336Q | A289P, N303S and N336Q |
| T85L, H121Y, N130K and M134L | T85L, H121Y, N130K and E154D | T85L, H121Y, N130K and N190D | T85L, H121Y, N130K H225Y | T85L, H121Y, N130K and N229E |
| T85L, H121Y, N130K and V258G | T85L, H121Y, N130K and A289P | T85L, H121Y, N130K and N303S | T85L, H121Y, N130K and N336Q | T85L, H121Y, M134L and E154D |
| T85L, H121Y, M134L and N190D | T85L, H121Y, M134L and H225Y | T85L, H121Y, M134L and N229E | T85L, H121Y, M134L V258G | T85L, H121Y, M134L and A289P |
| T85L, H121Y, M134L and N303S | T85L, H121Y, M134L and N336Q | T85L, H121Y, E154D and N190D | T85L, H121Y, E154D and H225Y | T85L, H121Y, E154D and N229E |
| T85L, H121Y, E154D and V258G | T85L, H121Y, E154D and A289P | T85L, H121Y, E154D and N303S | T85L, H121Y, E154D and N336Q | T85L, H121Y, N190D and H225Y |
| T85L, H121Y, N190D and N229E | T85L, H121Y, N190D and V258G | T85L, H121Y, N190D and A289P | T85L, H121Y, N190D and N303S | T85L, H121Y, N190D and N336Q |
| T85L, H121Y, H225Y and N229E | T85L, H121Y, H225Y and V258G | T85L, H121Y, H225Y and A289P | T85L, H121Y, H225Y and N303S | T85L, H121Y, H225Y and N336Q |
| T85L, H121Y, N229E and V258G | T85L, H121Y, N229E and A289P | T85L, H121Y, N229E and N303S | T85L, H121Y, N229E and N336Q | T85L, H121Y, V258G and A289P |
| T85L, H121Y, V258G and N303S | T85L, H121Y, V258G and N336Q | T85L, H121Y, A289P and N303S | T85L, H121Y, A289P and N336Q | T85L, H121Y, N303S and N336Q |
| T85L, N130K, M134L and E154D | T85L, N130K, M134L and N190D | T85L, N130K, M134L and H225Y | T85L, N130K, M134L N229E | T85L, N130K, M134L and V258G |
| T85L, N130K, M134L and A289P | T85L, N130K, M134L and N303S | T85L, N130K, M134L and N336Q | T85L, N130K, E154D and N190D | T85L, N130K, E154D and H225Y |
| T85L, N130K, E154D and N229E | T85L, N130K, E154D and V258G | T85L, N130K, E154D and A289P | T85L, N130K, E154D and N303S | T85L, N130K, E154D and N336Q |
| T85L, N130K, N190D and H225Y | T85L, N130K, N190D and N229E | T85L, N130K, N190D and V258G | T85L, N130K, N190D and A289P | T85L, N130K, N190D and N303S |
| T85L, N130K, N190D and N336Q | T85L, N130K, H225Y and N229E | T85L, N130K, H225Y and V258G | T85L, N130K, H225Y and A289P | T85L, N130K, H225Y and N303S |
| T85L, N130K, H225Y and N336Q | T85L, N130K, N229E and V258G | T85L, N130K, N229E and A289P | T85L, N130K, N229E and N303S | T85L, N130K, N229E and N336Q |
| T85L, N130K, V258G and A289P | T85L, N130K, V258G and N303S | T85L, N130K, V258G and N336Q | T85L, N130K, A289P and N303S | T85L, N130K, A289P and N336Q |
| T85L, N130K, N303S and N336Q | T85L, M134L, E154D and N190D | T85L, M134L, E154D and H225Y | T85L, M134L, E154D and N229E | T85L, M134L, E154D and V258G |
| T85L, M134L, E154D and A289P | T85L, M134L, E154D and N303S | T85L, M134L, E154D and N336Q | T85L, M134L, N190D and H225Y | T85L, M134L, N190D and N229E |
| T85L, M134L, N190D and V258G | T85L, M134L, N190D and A289P | T85L, M134L, N190D and N303S | T85L, M134L, N190D and N336Q | T85L, M134L, H225Y and N229E |
| T85L, M134L, H225Y and V258G | T85L, M134L, H225Y and A289P | T85L, M134L, H225Y and N303S | T85L, M134L, H225Y and N336Q | T85L, M134L, N229E and V258G |
| T85L, M134L, N229E and A289P | T85L, M134L, N229E and N303S | T85L, M134L, N229E and N336Q | T85L, M134L, V258G and A289P | T85L, M134L, V258G and N303S |
| T85L, M134L, V258G and N336Q | T85L, M134L, A289P and N303S | T85L, M134L, A289P and N336Q | T85L, M134L, N303S and N336Q | T85L, E154D, N190D and H225Y |
| T85L, E154D, N190D and N229E | T85L, E154D, N190D and V258G | T85L, E154D, N190D and A289P | T85L, E154D, N190D and N303S | T85L, E154D, N190D and N336Q |
| T85L, E154D, H225Y and N229E | T85L, E154D, H225Y and V258G | T85L, E154D, H225Y and A289P | T85L, E154D, H225Y and N303S | T85L, E154D, H225Y and N336Q |
| T85L, E154D, N229E and V258G | T85L, E154D, N229E and A289P | T85L, E154D, N229E and N303S | T85L, E154D, N229E and N336Q | T85L, E154D, V258G and A289P |

TABLE 21-continued

Non-limiting examples of mutations [as compared to SEQ ID NO: 35]

| | | | | |
|---|---|---|---|---|
| T85L, E154D, V258G and N303S | T85L, E154D, V258G and N303S | T85L, E154D, A289P and N336Q | T85L, E154D, A289P and N336Q | T85L, E154D, N303S and N336Q |
| T85L, N190D, H225Y and N229E | T85L, N190D, H225Y and V258G | T85L, N190D, H225Y and A289P | T85L, N190D, H225Y N303S | T85L, N190D, H225Y and N336Q |
| T85L, N190D, N229E and V258G | T85L, N190D, N229E and A289P | T85L, N190D, N229E and N303S | T85L, N190D, N229E and N336Q | T85L, N190D, V258G and A289P |
| T85L, N190D, V258G and N303S | T85L, N190D, V258G and N336Q | T85L, N190D, A289P and N303S | T85L, N190D, A289P and N336Q | T85L, N190D, N303S and N336Q |
| T85L, H225Y, N229E and V258G | T85L, H225Y, N229E and A289P | T85L, H225Y, N229E and N303S | T85L, H225Y, N229E and N336Q | T85L, H225Y, V258G and A289P |
| T85L, H225Y, V258G and N303S | T85L, H225Y, V258G and N336Q | T85L, H225Y, A289P and N303S | T85L, H225Y, A289P and N336Q | T85L, H225Y, N303S and N336Q |
| T85L, N229E, V258G and A289P | T85L, N229E, V258G and N303S | T85L, N229E, V258G and N336Q | T85L, N229E, A289P and N303S | T85L, N229E, A289P and N336Q |
| T85L, N229E, N303S and N336Q | T85L, V258G, A289P and N303S | T85L, V258G, A289P and N336Q | T85L, V258G, N303S and N336Q | T85L, A289P, N303S and N336Q |
| H121Y, N130K, M134L and E154D | H121Y, N130K, M134L and N190D | H121Y, N130K, M134L and H225Y | H121Y, N130K, M134L and N229E | H121Y, N130K, M134L and V258G |
| H121Y, N130K, M134L and A289P | H121Y, N130K, M134L and N303S | H121Y, N130K, M134L and N336Q | H121Y, N130K, E154D and N190D | H121Y, N130K, E154D and H225Y |
| H121Y, N130K, E154D and N229E | H121Y, N130K, E154D and V258G | H121Y, N130K, E154D and A289P | H121Y, N130K, E154D and N303S | H121Y, N130K, E154D and N336Q |
| H121Y, N130K, N190D and H225Y | H121Y, N130K, N190D and N229E | H121Y, N130K, N190D and V258G | H121Y, N130K, N190D and A289P | H121Y, N130K, N190D and N303S |
| H121Y, N130K, N190D and N336Q | H121Y, N130K, H225Y and N229E | H121Y, N130K, H225Y and V258G | H121Y, N130K, H225Y and A289P | H121Y, N130K, H225Y and N303S |
| H121Y, N130K, H225Y and N336Q | H121Y, N130K, N229E and V258G | H121Y, N130K, N229E and A289P | H121Y, N130K, N229E and N303S | H121Y, N130K, N229E and N336Q |
| H121Y, N130K, V258G and A289P | H121Y, N130K, V258G and N303S | H121Y, N130K, V258G and N336Q | H121Y, N130K, A289P and N303S | H121Y, N130K, A289P and N336Q |
| H121Y, N130K, N303S and N336Q | H121Y, M134L, E154D and N190D | H121Y, M134L, E154D and H225Y | H121Y, M134L, E154D and N229E | H121Y, M134L, E154D and V258G |
| H121Y, M134L, E154D and A289P | H121Y, M134L, E154D and N303S | H121Y, M134L, E154D and N336Q | H121Y, M134L, N190D and H225Y | H121Y, M134L, N190D and N229E |
| H121Y, M134L, N190D and V258G | H121Y, M134L, N190D and A289P | H121Y, M134L, N190D and N303S | H121Y, M134L, N190D and N336Q | H121Y, M134L, H225Y and N229E |
| H121Y, M134L, H225Y V258G | H121Y, M134L, H225Y and A289P | H121Y, M134L, H225Y and N303S | H121Y, M134L, H225Y and N336Q | H121Y, M134L, N229E and V258G |
| H121Y, M134L, N229E and A289P | H121Y, M134L, N229E and N336Q | H121Y, M134L, N229E and N303S | H121Y, M134L, V258G and A289P | H121Y, M134L, V258G and N303S |
| H121Y, M134L, V258G and N336Q | H121Y, M134L, A289P and N303S | H121Y, M134L, A289P and N336Q | H121Y, M134L, N303S and N336Q | H121Y, E154D, N190D and H225Y |
| H121Y, E154D, N190D and N229E | H121Y, E154D, N190D and A289P | H121Y, E154D, N190D and N303S | H121Y, E154D, N190D and N336Q | H121Y, E154D, N190D and N336Q |
| H121Y, E154D, H225Y and N229E | H121Y, E154D, H225Y and V258G | H121Y, E154D, H225Y and A289P | H121Y, E154D, H225Y and N303S | H121Y, E154D, H225Y and N336Q |
| H121Y, E154D, N229E and V258G | H121Y, E154D, N229E and A289P | H121Y, E154D, N229E and N303S | H121Y, E154D, N229E and N336Q | H121Y, E154D, V258G and A289P |
| H121Y, E154D, V258G and N303S | H121Y, E154D, V258G and N336Q | H121Y, E154D, A289P and N303S | H121Y, E154D, A289P and N336Q | H121Y, E154D, N303S and N336Q |
| H121Y, N190D, H225Y and N229E | H121Y, N190D, H225Y and V258G | H121Y, N190D, H225Y and A289P | H121Y, N190D, H225Y and N303S | H121Y, N190D, H225Y and N336Q |
| H121Y, N190D, N229E and V258G | H121Y, N190D, N229E and A289P | H121Y, N190D, N229E and N303S | H121Y, N190D, N229E and N336Q | H121Y, N190D, V258G and A289P |
| H121Y, N190D, V258G and N303S | H121Y, N190D, V258G and N336Q | H121Y, N190D, A289P and N303S | H121Y, N190D, A289P and N336Q | H121Y, N190D, N303S and N336Q |
| H121Y, H225Y, N229E and V258G | H121Y, H225Y, N229E and A289P | H121Y, H225Y, N229E and N303S | H121Y, H225Y, N229E and N336Q | H121Y, H225Y, V258G and A289P |
| H121Y, H225Y, V258G and N303S | H121Y, H225Y, V258G and N336Q | H121Y, H225Y, A289P and N303S | H121Y, H225Y, A289P and N336Q | H121Y, H225Y, N303S and N336Q |
| H121Y, N229E, V258G and A289P | H121Y, N229E, V258G and N303S | H121Y, N229E, V258G and N336Q | H121Y, N229E, A289P and N303S | H121Y, N229E, A289P and N336Q |
| H121Y, N229E, N303S and N336Q | H121Y, V258G, A289P and N303S | H121Y, V258G, A289P and N336Q | H121Y, V258G, N303S and N336Q | H121Y, A289P, N303S and N336Q |
| N130K, M134L, E154D and N190D | N130K, M134L, E154D and H225Y | N130K, M134L, E154D and N229E | N130K, M134L, E154D and V258G | N130K, M134L, E154D and A289P |
| N130K, M134L, E154D and N303S | N130K, M134L, E154D and N336Q | N130K, M134L, N190D and H225Y | N130K, M134L, N190D and N229E | N130K, M134L, N190D and V258G |
| N130K, M134L, N190D and A289P | N130K, M134L, N190D and N303S | N130K, M134L, N190D and N336Q | N130K, M134L, H225Y and N229E | N130K, M134L, H225Y and V258G |
| N130K, M134L, H225Y and A289P | N130K, M134L, H225Y and N303S | N130K, M134L, H225Y and N336Q | N130K, M134L, N229E and V258G | N130K, M134L, N229E and A289P |
| N130K, M134L, N229E and N303S | N130K, M134L, N229E and N336Q | N130K, M134L, V258G and A289P | N130K, M134L, V258G and N303S | N130K, M134L, V258G and N336Q |
| N130K, M134L, A289P and N303S | N130K, M134L, A289P and N336Q | N130K, M134L, N303S and N336Q | N130K, E154D, N190D and H225Y | N130K, E154D, N190D and N229E |
| N130K, E154D, N190D and V258G | N130K, E154D, N190D and A289P | N130K, E154D, N190D and N303S | N130K, E154D, N190D and N336Q | N130K, E154D, H225Y and N229E |

TABLE 21-continued

Non-limiting examples of mutations [as compared to SEQ ID NO: 35]

| | | | | |
|---|---|---|---|---|
| N130K, E154D, H225Y and V258G | N130K, E154D, H225Y and A289P | N130K, E154D, H225Y and N303S | N130K, E154D, H225Y and N336Q | N130K, E154D, N229E and V258G |
| N130K, E154D, N229E A289P | N130K, E154D, N229E and N303S | N130K, E154D, N229E and N336Q | N130K, E154D, A289P and N336Q | N130K, E154D, V258G and N303S |
| N130K, E154D, V258G N336Q | N130K, E154D, A289P and N303S | N130K, E154D, A289P and N336Q | N130K, E154D, N303S and N336Q | N130K, N190D, H225Y and N229E |
| N130K, N190D, H225Y and V258G | N130K, N190D, H225Y and A289P | N130K, N190D, H225Y and N303S | N130K, N190D, H225Y and N336Q | N130K, N190D, N229E and V258G |
| N130K, N190D, N229E and A289P | N130K, N190D, N229E and N303S | N130K, N190D, N229E and N336Q | N130K, N190D, V258G and A289P | N130K, N190D, V258G and N303S |
| N130K, N190D, V258G and N336Q | N130K, N190D, A289P and N303S | N130K, N190D, A289P and N336Q | N130K, N190D, N303S and N336Q | N130K, H225Y, N229E and V258G |
| N130K, H225Y, N229E and A289P | N130K, H225Y, N229E and N303S | N130K, H225Y, N229E and N336Q | N130K, H225Y, V258G and A289P | N130K, H225Y, V258G and N303S |
| N130K, H225Y, V258G and N336Q | N130K, H225Y, A289P and N303S | N130K, H225Y, A289P and N336Q | N130K, H225Y, N303S and N336Q | N130K, N229E, V258G and A289P |
| N130K, N229E, V258G and N303S | N130K, N229E, V258G and N336Q | N130K, N229E, A289P and N303S | N130K, N229E, A289P and N336Q | N130K, N229E, N303S and N336Q |
| N130K, V258G, A289P and N303S | N130K, V258G, A289P and N336Q | N130K, V258G, N303S and N336Q | N130K, A289P, N303S and N336Q | M134L, E154D, N190D and H225Y |
| M134L, E154D, N190D and N229E | M134L, E154D, N190D and V258G | M134L, E154D, N190D and A289P | M134L, E154D, N190D and N303S | M134L, E154D, N190D and N336Q |
| M134L, E154D, H225Y and N229E | M134L, E154D, H225Y and V258G | M134L, E154D, H225Y and A289P | M134L, E154D, H225Y and N303S | M134L, E154D, H225Y and N336Q |
| M134L, E154D, N229E and V258G | M134L, E154D, N229E and A289P | M134L, E154D, N229E and N303S | M134L, E154D, N229E and N336Q | M134L, E154D, V258G and A289P |
| M134L, E154D, V258G and N303S | M134L, E154D, V258G and N336Q | M134L, E154D, A289P and N303S | M134L, E154D, A289P and N336Q | M134L, E154D, N303S and N336Q |
| M134L, N190D, H225Y and N229E | M134L, N190D, H225Y and V258G | M134L, N190D, H225Y and A289P | M134L, N190D, H225Y and N303S | M134L, N190D, H225Y and N336Q |
| M134L, N190D, N229E and V258G | M134L, N190D, N229E and A289P | M134L, N190D, N229E and N303S | M134L, N190D, N229E and N336Q | M134L, N190D, V258G and A289P |
| M134L, N190D, V258G and N303S | M134L, N190D, V258G and N336Q | M134L, N190D, A289P and N303S | M134L, N190D, A289P and N336Q | M134L, N190D, N303S and N336Q |
| M134L, H225Y, N229E and V258G | M134L, H225Y, N229E and A289P | M134L, H225Y, N229E and N303S | M134L, H225Y, N229E and N336Q | M134L, H225Y, V258G and A289P |
| M134L, H225Y, V258G and N303S | M134L, H225Y, V258G and N336Q | M134L, H225Y, A289P and N303S | M134L, H225Y, A289P and N336Q | M134L, H225Y, N303S and N336Q |
| M134L, N229E, V258G and A289P | M134L, N229E, V258G and N303S | M134L, N229E, V258G and N336Q | M134L, N229E, A289P and N303S | M134L, N229E, A289P and N336Q |
| M134L, N229E, N303S and N336Q | M134L, V258G, A289P and N303S | M134L, V258G, A289P and N336Q | M134L, V258G, N303S and N336Q | M134L, A289P, N303S and N336Q |
| E154D, N190D, H225Y and N229E | E154D, N190D, H225Y and V258G | E154D, N190D, H225Y and A289P | E154D, N190D, H225Y and N303S | E154D, N190D, H225Y and N336Q |
| E154D, N190D, N229E and V258G | E154D, N190D, N229E and A289P | E154D, N190D, N229E and N303S | E154D, N190D, N229E and N336Q | E154D, N190D, V258G and A289P |
| E154D, N190D, V258G and N303S | E154D, N190D, V258G and N336Q | E154D, N190D, A289P and N303S | E154D, N190D, A289P and N336Q | E154D, N190D, N303S and N336Q |
| E154D, H225Y, N229E and V258G | E154D, H225Y, N229E and A289P | E154D, H225Y, N229E and N303S | E154D, H225Y, N229E and N336Q | E154D, H225Y, V258G and A289P |
| E154D, H225Y, V258G and N303S | E154D, H225Y, V258G and N336Q | E154D, H225Y, A289P and N303S | E154D, H225Y, A289P and N336Q | E154D, H225Y, N303S and N336Q |
| E154D, N229E, V258G and A289P | E154D, N229E, V258G and N303S | E154D, N229E, V258G and N336Q | E154D, N229E, A289P and N303S | E154D, N229E, A289P and N336Q |
| E154D, N229E, N303S and N336Q | E154D, V258G, A289P and N303S | E154D, V258G, A289P and N336Q | E154D, V258G, N303S and N336Q | E154D, A289P, N303S and N336Q |
| N190D, H225Y, N229E and V258G | N190D, H225Y, N229E and A289P | N190D, H225Y, N229E and N303S | N190D, H225Y, N229E and N336Q | N190D, H225Y, V258G and A289P |
| N190D, H225Y, V258G and N303S | N190D, H225Y, V258G and N336Q | N190D, H225Y, A289P and N303S | N190D, H225Y, A289P and N336Q | N190D, H225Y, N303S and N336Q |
| N190D, N229E, V258G and A289P | N190D, N229E, V258G and N303S | N190D, N229E, V258G and N336Q | N190D, N229E, A289P and N303S | N190D, N229E, A289P and N336Q |
| N190D, N229E, N303S and N336Q | N190D, V258G, A289P and N303S | N190D, V258G, A289P and N336Q | N190D, V258G, N303S and N336Q | N190D, A289P, N303S and N336Q |
| H225Y, N229E, V258G and A289P | H225Y, N229E, V258G and N303S | H225Y, N229E, V258G and N336Q | H225Y, N229E, A289P and N303S | H225Y, N229E, A289P and N336Q |
| H225Y, N229E, N303S and N336Q | H225Y, V258G, A289P and N303S | H225Y, V258G, A289P and N336Q | H225Y, V258G, N303S and N336Q | H225Y, A289P, N303S and N336Q |
| N229E, V258G, A289P and N303S | N229E, V258G, A289P and N336Q | N229E, V258G, N303S and N336Q | N229E, A289P, N303S and N336Q | V258G, A289P, N303S and N336Q |
| A60T, N61D, T63I and Q64K | A60T, N61D, T63I and V74K | A60T, N61D, T63I and N76G | A60T, N61D, T63I and H146S | A60T, N61D, T63I and F227L |
| A60T, N61D, T63I and E229N | A60T, N61D, Q64K and V74K | A60T, N61D, Q64K and N76G | A60T, N61D, Q64K and H146S | A60T, N61D, Q64K and F227L |
| A60T, N61D, Q64K and E229N | A60T, N61D, V74K and N76G | A60T, N61D, V74K and H146S | A60T, N61D, V74K and F227L | A60T, N61D, V74K and E229N |
| A60T, N61D, N76G and H146S | A60T, N61D, N76G and F227L | A60T, N61D, N76G and E229N | A60T, N61D, H146S and F227L | A60T, N61D, H146S and E229N |

TABLE 21-continued

Non-limiting examples of mutations [as compared to SEQ ID NO: 35]

| | | | | |
|---|---|---|---|---|
| A60T, N61D, F227L and E229N | A60T, T63I, Q64K and V74K | A60T, T63I, Q64K and N76G | A60T, T63I, Q64K and H146S | A60T, T63I, Q64K and F227L |
| A60T, T63I, Q64K and E229N | A60T, T63I, V74K and N76G | A60T, T63I, V74K and H146S | A60T, T63I, V74K and F227L | A60T, T63I, V74K and E229N |
| A60T, T63I, N76G and H146S | A60T, T63I, N76G and F227L | A60T, T63I, N76G and E229N | A60T, T63I, H146S and F227L | A60T, T63I, H146S and E229N |
| A60T, T63I, F227L and E229N | A60T, Q64K, V74K and N76G | A60T, Q64K, V74K and H146S | A60T, Q64K, V74K and F227L | A60T, Q64K, V74K and E229N |
| A60T, Q64K, N76G and H146S | A60T, Q64K, N76G and F227L | A60T, Q64K, N76G and E229N | A60T, Q64K, H146S and F227L | A60T, Q64K, H146S and E229N |
| A60T, Q64K, F227L and E229N | A60T, V74K, N76G and H146S | A60T, V74K, N76G and F227L | A60T, V74K, N76G and E229N | A60T, V74K, H146S and F227L |
| A60T, V74K, H146S and E229N | A60T, V74K, F227L and E229N | A60T, N76G, H146S and F227L | A60T, N76G, H146S and E229N | A60T, N76G, F227L and E229N |
| A60T, H146S, F227L and E229N | N61D, T63I, Q64K and V74K | N61D, T63I, Q64K and N76G | N61D, T63I, Q64K and H146S | N61D, T63I, Q64K and F227L |
| N61D, T63I, Q64K and E229N | N61D, T63I, V74K and N76G | N61D, T63I, V74K and H146S | N61D, T63I, V74K and F227L | N61D, T63I, V74K and E229N |
| N61D, T63I, N76G and H146S | N61D, T63I, N76G and F227L | N61D, T63I, N76G and E229N | N61D, T63I, H146S and F227L | N61D, T63I, H146S and E229N |
| N61D, T63I, F227L and E229N | N61D, Q64K, V74K and N76G | N61D, Q64K, V74K and H146S | N61D, Q64K, V74K and F227L | N61D, Q64K, V74K and E229N |
| N61D, Q64K, N76G and H146S | N61D, Q64K, N76G and F227L | N61D, Q64K, N76G and E229N | N61D, Q64K, H146S and F227L | N61D, Q64K, H146S and E229N |
| N61D, Q64K, F227L and E229N | N61D, V74K, N76G and H146S | N61D, V74K, N76G and F227L | N61D, V74K, N76G and E229N | N61D, V74K, H146S and F227L |
| N61D, V74K, H146S and E229N | N61D, V74K, F227L and E229N | N61D, N76G, H146S and F227L | N61D, N76G, H146S and E229N | N61D, N76G, F227L and E229N |
| N61D, H146S, F227L and E229N | T63I, Q64K, V74K and N76G | T63I, Q64K, V74K and H146S | T63I, Q64K, V74K and F227L | T63I, Q64K, V74K and E229N |
| T63I, Q64K, N76G and H146S | T63I, Q64K, N76G and F227L | T63I, Q64K, N76G and E229N | T63I, Q64K, H146S and F227L | T63I, Q64K, H146S and E229N |
| T63I, Q64K, F227L and E229N | T63I, V74K, N76G and H146S | T63I, V74K, N76G and F227L | T63I, V74K, N76G and E229N | T63I, V74K, H146S and F227L |
| T63I, V74K, H146S and E229N | T63I, V74K, F227L and E229N | T63I, N76G, H146S and F227L | T63I, N76G, H146S and E229N | T63I, N76G, F227L and E229N |
| T63I, H146S, F227L and E229N | Q64K, V74K, N76G and H146S | Q64K, V74K, N76G and F227L | Q64K, V74K, N76G and E229N | Q64K, V74K, H146S and F227L |
| Q64K, V74K, H146S and E229N | Q64K, V74K, F227L and E229N | Q64K, N76G, H146S and F227L | Q64K, N76G, H146S and E229N | Q64K, N76G, F227L and E229N |
| Q64K, H146S, F227L and E229N | V74K, N76G, H146S and F227L | V74K, N76G, H146S and E229N | V74K, N76G, F227L and E229N | V74K, H146S, F227L and E229N |
| N76G, H146S, F227L and E229N | A60T, N61D, T63I, Q64K and V74K | A60T, N61D, T63I, Q64K and N76G | A60T, N61D, T63I, Q64K and H146S | A60T, N61D, T63I, Q64K and F227L |
| A60T, N61D, T63I, Q64K and E229N | A60T, N61D, T63I, V74K and N76G | A60T, N61D, T63I, V74K and H146S | A60T, N61D, T63I, V74K and F227L | A60T, N61D, T63I, V74K and E229N |
| A60T, N61D, T63I, N76G and H146S | A60T, N61D, T63I, N76G and F227L | A60T, N61D, T63I, N76G and E229N | A60T, N61D, T63I, H146S and F227L | A60T, N61D, T63I, H146S and E229N |
| A60T, N61D, T63I, F227L and E229N | A60T, N61D, Q64K, V74K and N76G | A60T, N61D, Q64K, V74K and H146S | A60T, N61D, Q64K, V74K and F227L | A60T, N61D, Q64K, V74K and E229N |
| A60T, N61D, Q64K, N76G and H146S | A60T, N61D, Q64K, N76G and F227L | A60T, N61D, Q64K, N76G and E229N | A60T, N61D, Q64K, H146S and F227L | A60T, N61D, Q64K, H146S and E229N |
| A60T, N61D, Q64K, F227L and E229N | A60T, N61D, V74K, N76G and H146S | A60T, N61D, V74K, N76G and F227L | A60T, N61D, V74K, N76G and E229N | A60T, N61D, V74K, H146S and F227L |
| A60T, N61D, V74K, H146S and E229N | A60T, N61D, V74K, F227L and E229N | A60T, N61D, N76G, H146S and F227L | A60T, N61D, N76G, H146S and E229N | A60T, N61D, N76G, F227L and E229N |
| A60T, N61D, H146S, F227L and E229N | A60T, T63I, Q64K, V74K and N76G | A60T, T63I, Q64K, V74K and H146S | A60T, T63I, Q64K, V74K and F227L | A60T, T63I, Q64K, V74K and E229N |
| A60T, T63I, Q64K, N76G and H146S | A60T, T63I, Q64K, N76G and F227L | A60T, T63I, Q64K, N76G and E229N | A60T, T63I, Q64K, H146S and F227L | A60T, T63I, Q64K, H146S and E229N |
| A60T, T63I, Q64K, F227L and E229N | A60T, T63I, V74K, N76G and H146S | A60T, T63I, V74K, N76G and F227L | A60T, T63I, V74K, N76G and E229N | A60T, T63I, V74K, H146S and F227L |
| A60T, T63I, V74K, H146S and E229N | A60T, T63I, V74K, F227L and E229N | A60T, T63I, N76G, H146S and F227L | A60T, T63I, N76G, H146S and E229N | A60T, T63I, N76G, F227L and E229N |
| A60T, T63I, H146S, F227L and E229N | A60T, Q64K, V74K, N76G and H146S | A60T, Q64K, V74K, N76G and F227L | A60T, Q64K, V74K, N76G and E229N | A60T, Q64K, V74K, H146S and F227L |
| A60T, Q64K, V74K, H146S and E229N | A60T, Q64K, V74K, F227L and E229N | A60T, Q64K, N76G, H146S and F227L | A60T, Q64K, N76G, H146S and E229N | A60T, Q64K, N76G, F227L and E229N |
| A60T, Q64K, H146S, F227L and E229N | A60T, Q64K, V74K, N76G, H146S and F227L | A60T, V74K, N76G, H146S and E229N | A60T, V74K, N76G, F227L and E229N | A60T, V74K, H146S, F227L and E229N |
| A60T, N76G, H146S, F227L and E229N | N61D, T63I, Q64K, V74K and N76G | N61D, T63I, Q64K, V74K and H146S | N61D, T63I, Q64K, V74K and F227L | N61D, T63I, Q64K, V74K and E229N |
| N61D, T63I, Q64K, N76G and H146S | N61D, T63I, Q64K, N76G and F227L | N61D, T63I, Q64K, N76G and E229N | N61D, T63I, Q64K, H146S and F227L | N61D, T63I, Q64K, H146S and E229N |
| N61D, T63I, Q64K, F227L and E229N | N61D, T63I, V74K, N76G and H146S | N61D, T63I, V74K, N76G and F227L | N61D, T63I, V74K, N76G and E229N | N61D, T63I, V74K, H146S and F227L |
| N61D, T63I, V74K, H146S and E229N | N61D, T63I, V74K, F227L and E229N | N61D, T63I, N76G, H146S and F227L | N61D, T63I, N76G, H146S and E229N | N61D, T63I, N76G, F227L and E229N |

TABLE 21-continued

Non-limiting examples of mutations [as compared to SEQ ID NO: 35]

| | | | | |
|---|---|---|---|---|
| N61D, T63I, H146S, F227L and E229N | N61D, Q64K, V74K, N76G and H146S | N61D, Q64K, V74K, N76G and F227L | N61D, Q64K, V74K, N76G and E229N | N61D, Q64K, V74K, H146S and F227L |
| N61D, Q64K, V74K, H146S and E229N | N61D, Q64K, V74K, F227L and E229N | N61D, Q64K, N76G, H146S and F227L | N61D, Q64K, N76G, H146S and E229N | N61D, Q64K, N76G, F227L and E229N |
| N61D, Q64K, H146S, F227L and E229N | N61D, V74K, N76G, H146S and F227L | N61D, V74K, N76G, H146S and E229N | N61D, V74K, N76G, F227L and E229N | N61D, V74K, H146S, F227L and E229N |
| N61D, N76G, H146S, F227L and E229N | T63I, Q64K, V74K, N76G and H146S | T63I, Q64K, V74K, N76G and F227L | T63I, Q64K, V74K, N76G and E229N | T63I, Q64K, V74K, H146S and F227L |
| T63I, Q64K, V74K, H146S and E229N | T63I, Q64K, V74K, F227L and E229N | T63I, Q64K, N76G, H146S and F227L | T63I, Q64K, N76G, H146S and E229N | T63I, Q64K, N76G, F227L and E229N |
| T63I, Q64K, H146S, F227L and E229N | T63I, V74K, N76G, H146S and F227L | T63I, V74K, N76G, H146S and E229N | T63I, V74K, N76G, F227L and E229N | T63I, V74K, H146S, F227L and E229N |
| T63I, N76G, H146S, F227L and E229N | Q64K, V74K, N76G, H146S and F227L | Q64K, V74K, N76G, H146S and E229N | Q64K, V74K, N76G, F227L and E229N | Q64K, V74K, H146S, F227L and E229N |
| Q64K, N76G, H146S, F227L and E229N | V74K, N76G, H146S, F227L and E229NT85L, H121Y, N130K, M134L and E154D | T85L, H121Y, N130K, M134L and N190D | T85L, H121Y, N130K, M134L and H225Y | T85L, H121Y, N130K, M134L and N229E |
| T85L, H121Y, N130K, M134L and V258G | T85L, H121Y, N130K, M134L and A289P | T85L, H121Y, N130K, M134L and N303S | T85L, H121Y, N130K, M134L and N336Q | T85L, H121Y, N130K, E154D and N190D |
| T85L, H121Y, N130K, E154D and H225Y | T85L, H121Y, N130K, E154D and N229E | T85L, H121Y, N130K, E154D and V258G | T85L, H121Y, N130K, E154D and A289P | T85L, H121Y, N130K, E154D and N303S |
| T85L, H121Y, N130K, E154D and N336Q | T85L, H121Y, N130K, N190D and H225Y | T85L, H121Y, N130K, N190D and N229E | T85L, H121Y, N130K, N190D and V258G | T85L, H121Y, N130K, N190D and A289P |
| T85L, H121Y, N130K, N190D and N303S | T85L, H121Y, N130K, N190D and N336Q | T85L, H121Y, N130K, H225Y and N229E | T85L, H121Y, N130K, H225Y and V258G | T85L, H121Y, N130K, H225Y and A289P |
| T85L, H121Y, N130K, H225Y and N303S | T85L, H121Y, N130K, H225Y and N336Q | T85L, H121Y, N130K, N229E and V258G | T85L, H121Y, N130K, N229E and A289P | T85L, H121Y, N130K, N229E and N303S |
| T85L, H121Y, N130K, N229E and N336Q | T85L, H121Y, N130K, V258G and A289P | T85L, H121Y, N130K, V258G and N303S | T85L, H121Y, N130K, V258G and N336Q | T85L, H121Y, N130K, A289P and N303S |
| T85L, H121Y, N130K, A289P and N336Q | T85L, H121Y, N130K, N303S and N336Q | T85L, H121Y, M134L, E154D and N190D | T85L, H121Y, M134L, E154D and H225Y | T85L, H121Y, M134L, E154D and N229E |
| T85L, H121Y, M134L, E154D and V258G | T85L, H121Y, M134L, E154D and A289P | T85L, H121Y, M134L, E154D and N303S | T85L, H121Y, M134L, E154D and N336Q | T85L, H121Y, M134L, N190D and H225Y |
| T85L, H121Y, M134L, N190D and N229E | T85L, H121Y, M134L, N190D and V258G | T85L, H121Y, M134L, N190D and A289P | T85L, H121Y, M134L, N190D and N303S | T85L, H121Y, M134L, N190D and N336Q |
| T85L, H121Y, M134L, H225Y and N229E | T85L, H121Y, M134L, H225Y and V258G | T85L, H121Y, M134L, H225Y and A289P | T85L, H121Y, M134L, H225Y and N303S | T85L, H121Y, M134L, H225Y and N336Q |
| T85L, H121Y, M134L, N229E and V258G | T85L, H121Y, M134L, N229E and A289P | T85L, H121Y, M134L, N229E and N303S | T85L, H121Y, M134L, N229E and N336Q | T85L, H121Y, M134L, V258G and A289P |
| T85L, H121Y, M134L, V258G and N303S | T85L, H121Y, M134L, V258G and N336Q | T85L, H121Y, M134L, A289P and N303S | T85L, H121Y, M134L, A289P and N336Q | T85L, H121Y, M134L, N303S and N336Q |
| T85L, H121Y, E154D, N190D and H225Y | T85L, H121Y, E154D, N190D and N229E | T85L, H121Y, E154D, N190D and V258G | T85L, H121Y, E154D, N190D and A289P | T85L, H121Y, E154D, N190D and N303S |
| T85L, H121Y, E154D, N190D and N336Q | T85L, H121Y, E154D, H225Y and N229E | T85L, H121Y, E154D, H225Y and V258G | T85L, H121Y, E154D, H225Y and A289P | T85L, H121Y, E154D, H225Y and N303S |
| T85L, H121Y, E154D, H225Y and N336Q | T85L, H121Y, E154D, N229E and V258G | T85L, H121Y, E154D, N229E and A289P | T85L, H121Y, E154D, N229E and N303S | T85L, H121Y, E154D, N229E and N336Q |
| T85L, H121Y, E154D, V258G and A289P | T85L, H121Y, E154D, V258G and N303S | T85L, H121Y, E154D, V258G and N336Q | T85L, H121Y, E154D, A289P and N303S | T85L, H121Y, E154D, A289P and N336Q |
| T85L, H121Y, E154D, N303S and N336Q | T85L, H121Y, N190D, H225Y and N229E | T85L, H121Y, N190D, H225Y and V258G | T85L, H121Y, N190D, H225Y and A289P | T85L, H121Y, N190D, H225Y and N303S |
| T85L, H121Y, N190D, H225Y and N336Q | T85L, H121Y, N190D, N229E and V258G | T85L, H121Y, N190D, N229E and A289P | T85L, H121Y, N190D, N229E and N303S | T85L, H121Y, N190D, N229E and N336Q |
| T85L, H121Y, N190D, V258G and A289P | T85L, H121Y, N190D, V258G and N303S | T85L, H121Y, N190D, V258G and N336Q | T85L, H121Y, N190D, A289P and N303S | T85L, H121Y, N190D, A289P and N336Q |
| T85L, H121Y, H225Y, N303S and N336Q | T85L, H121Y, H225Y, N229E and V258G | T85L, H121Y, H225Y, N229E and A289P | T85L, H121Y, H225Y, N229E and N303S | T85L, H121Y, H225Y, N229E and N336Q |
| T85L, H121Y, H225Y, V258G and A289P | T85L, H121Y, H225Y, V258G and N303S | T85L, H121Y, H225Y, V258G and N336Q | T85L, H121Y, H225Y, A289P and N303S | T85L, H121Y, H225Y, A289P and N336Q |
| T85L, H121Y, H225Y, N303S and N336Q | T85L, H121Y, N229E, V258G and A289P | T85L, H121Y, N229E, V258G and N303S | T85L, H121Y, N229E, V258G and N336Q | T85L, H121Y, N229E, A289P and N303S |
| T85L, H121Y, N229E, A289P and N336Q | T85L, H121Y, N229E, N303S and N336Q | T85L, H121Y, V258G, A289P and N303S | T85L, H121Y, V258G, A289P and N336Q | T85L, H121Y, V258G, N303S and N336Q |
| T85L, H121Y, A289P, N303S and N336Q | T85L, N130K, M134L, E154D and N190D | T85L, N130K, M134L, E154D and H225Y | T85L, N130K, M134L, E154D and N229E | T85L, N130K, M134L, E154D and V258G |
| T85L, N130K, M134L, E154D and A289P | T85L, N130K, M134L, E154D and N303S | T85L, N130K, M134L, E154D and N336Q | T85L, N130K, M134L, N190D and H225Y | T85L, N130K, M134L, N190D and N229E |
| T85L, N130K, M134L, N190D and V258G | T85L, N130K, M134L, N190D and A289P | T85L, N130K, M134L, N190D and N303S | T85L, N130K, M134L, N190D and N336Q | T85L, N130K, M134L, H225Y and N229E |
| T85L, N130K, M134L, H225Y and V258G | T85L, N130K, M134L, H225Y and A289P | T85L, N130K, M134L, H225Y and N303S | T85L, N130K, M134L, H225Y and N336Q | T85L, N130K, M134L, N229E and V258G |
| T85L, N130K, M134L, N229E and A289P | T85L, N130K, M134L, N229E and N303S | T85L, N130K, M134L, N229E and N336Q | T85L, N130K, M134L, V258G and A289P | T85L, N130K, M134L, V258G and N303S |
| T85L, N130K, M134L, V258G and N336Q | T85L, N130K, M134L, A289P and N303S | T85L, N130K, M134L, A289P and N336Q | T85L, N130K, M134L, N303S and N336Q | T85L, N130K, E154D, N190D and H225Y |
| T85L, N130K, E154D, N190D and N229E | T85L, N130K, E154D, N190D and V258G | T85L, N130K, E154D, N190D and A289P | T85L, N130K, E154D, N190D and N303S | T85L, N130K, E154D, N190D and N336Q |

TABLE 21-continued

| Non-limiting examples of mutations [as compared to SEQ ID NO: 35] | | | | |
|---|---|---|---|---|
| T85L, N130K, E154D, H225Y and N229E | T85L, N130K, E154D, H225Y and V258G | T85L, N130K, E154D, H225Y and A289P | T85L, N130K, E154D, H225Y and N303S | T85L, N130K, E154D, H225Y and N336Q |
| T85L, N130K, E154D, N229E and V258G | T85L, N130K, E154D, N229E and A289P | T85L, N130K, E154D, N229E and N303S | T85L, N130K, E154D, N229E and N336Q | T85L, N130K, E154D, V258G and A289P |
| T85L, N130K, E154D, V258G and N303S | T85L, N130K, E154D, V258G and N336Q | T85L, N130K, E154D, A289P and N303S | T85L, N130K, E154D, A289P and N336Q | T85L, N130K, E154D, N303S and N336Q |
| T85L, N130K, N190D, H225Y and N229E | T85L, N130K, N190D, H225Y and V258G | T85L, N130K, N190D, H225Y and A289P | T85L, N130K, N190D, H225Y and N303S | T85L, N130K, N190D, H225Y and N336Q |
| T85L, N130K, N190D, N229E and V258G | T85L, N130K, N190D, N229E and A289P | T85L, N130K, N190D, N229E and N303S | T85L, N130K, N190D, N229E and N336Q | T85L, N130K, N190D, V258G and A289P |
| T85L, N130K, N190D, V258G and N303S | T85L, N130K, N190D, V258G and N336Q | T85L, N130K, N190D, A289P and N303S | T85L, N130K, N190D, A289P and N336Q | T85L, N130K, N190D, N303S and N336Q |
| T85L, N130K, H225Y, N229E and V258G | T85L, N130K, H225Y, N229E and A289P | T85L, N130K, H225Y, N229E and N303S | T85L, N130K, H225Y, N229E and N336Q | T85L, N130K, H225Y, V258G and A289P |
| T85L, N130K, H225Y, V258G and N303S | T85L, N130K, H225Y, V258G and N336Q | T85L, N130K, H225Y, A289P and N303S | T85L, N130K, H225Y, A289P and N336Q | T85L, N130K, H225Y, N303S and N336Q |
| T85L, N130K, N229E, V258G and A289P | T85L, N130K, N229E, V258G and N303S | T85L, N130K, N229E, V258G and N336Q | T85L, N130K, N229E, A289P and N303S | T85L, N130K, N229E, A289P and N336Q |
| T85L, N130K, N229E, N303S and N336Q | T85L, N130K, V258G, A289P and N303S | T85L, N130K, V258G, A289P and N336Q | T85L, N130K, V258G, N303S and N336Q | T85L, N130K, A289P, N303S and N336Q |
| T85L, M134L, E154D, N190D and H225Y | T85L, M134L, E154D, N190D and N229E | T85L, M134L, E154D, N190D and V258G | T85L, M134L, E154D, N190D and A289P | T85L, M134L, E154D, N190D and N303S |
| T85L, M134L, E154D, N190D and N336Q | T85L, M134L, E154D, H225Y and N229E | T85L, M134L, E154D, H225Y and V258G | T85L, M134L, E154D, H225Y and A289P | T85L, M134L, E154D, H225Y and N303S |
| T85L, M134L, E154D, H225Y and N336Q | T85L, M134L, E154D, N229E and V258G | T85L, M134L, E154D, N229E and A289P | T85L, M134L, E154D, N229E and N303S | T85L, M134L, E154D, N229E and N336Q |
| T85L, M134L, E154D, V258G and A289P | T85L, M134L, E154D, V258G and N303S | T85L, M134L, E154D, V258G and N336Q | T85L, M134L, E154D, A289P and N303S | T85L, M134L, E154D, A289P and N336Q |
| T85L, M134L, E154D, N303S and N336Q | T85L, M134L, N190D, H225Y and N229E | T85L, M134L, N190D, H225Y and V258G | T85L, M134L, N190D, H225Y and A289P | T85L, M134L, N190D, H225Y and N303S |
| T85L, M134L, N190D, H225Y and N336Q | T85L, M134L, N190D, N229E and V258G | T85L, M134L, N190D, N229E and A289P | T85L, M134L, N190D, N229E and N303S | T85L, M134L, N190D, N229E and N336Q |
| T85L, M134L, N190D, V258G and A289P | T85L, M134L, N190D, V258G and N303S | T85L, M134L, N190D, V258G and N336Q | T85L, M134L, N190D, A289P and N303S | T85L, M134L, N190D, A289P and N336Q |
| T85L, M134L, N190D, N303S and N336Q | T85L, M134L, H225Y, N229E and V258G | T85L, M134L, H225Y, N229E and A289P | T85L, M134L, H225Y, N229E and N303S | T85L, M134L, H225Y, N229E and N336Q |
| T85L, M134L, H225Y, V258G and A289P | T85L, M134L, H225Y, V258G and N303S | T85L, M134L, H225Y, V258G and N336Q | T85L, M134L, H225Y, A289P and N303S | T85L, M134L, H225Y, A289P and N336Q |
| T85L, M134L, H225Y, N303S and N336Q | T85L, M134L, N229E, V258G and A289P | T85L, M134L, N229E, V258G and N336Q | T85L, M134L, N229E, V258G and N336Q | T85L, M134L, N229E, A289P and N303S |
| T85L, M134L, N229E, A289P and N336Q | T85L, M134L, N229E, N303S and N336Q | T85L, M134L, V258G, A289P and N303S | T85L, M134L, V258G, A289P and N336Q | T85L, M134L, V258G, N303S and N336Q |
| T85L, M134L, A289P, N303S and N336Q | T85L, E154D, N190D, H225Y and N229E | T85L, E154D, N190D, H225Y and V258G | T85L, E154D, N190D, H225Y and A289P | T85L, E154D, N190D, H225Y and N303S |
| T85L, E154D, N190D, H225Y and N336Q | T85L, E154D, N190D, N229E and V258G | T85L, E154D, N190D, N229E and A289P | T85L, E154D, N190D, N229E and N303S | T85L, E154D, N190D, N229E and N336Q |
| T85L, E154D, N190D, V258G and A289P | T85L, E154D, N190D, V258G and N303S | T85L, E154D, N190D, V258G and N336Q | T85L, E154D, N190D, A289P and N303S | T85L, E154D, N190D, A289P and N336Q |
| T85L, E154D, N190D, N303S and N336Q | T85L, E154D, H225Y, N229E and V258G | T85L, E154D, H225Y, N229E and A289P | T85L, E154D, H225Y, N229E and N303S | T85L, E154D, H225Y, N229E and N336Q |
| T85L, E154D, H225Y, V258G and A289P | T85L, E154D, H225Y, V258G and N303S | T85L, E154D, H225Y, V258G and N336Q | T85L, E154D, H225Y, A289P and N303S | T85L, E154D, H225Y, A289P and N336Q |
| T85L, E154D, H225Y, N303S and N336Q | T85L, E154D, N229E, V258G and A289P | T85L, E154D, N229E, V258G and N303S | T85L, E154D, N229E, V258G and N336Q | T85L, E154D, N229E, A289P and N303S |
| T85L, E154D, N229E, A289P and N336Q | T85L, E154D, N229E, N303S and N336Q | T85L, E154D, V258G, A289P and N303S | T85L, E154D, V258G, A289P and N336Q | T85L, E154D, V258G, N303S and N336Q |
| T85L, E154D, A289P, N303S and N336Q | T85L, N190D, H225Y, N229E and V258G | T85L, N190D, H225Y, N229E and A289P | T85L, N190D, H225Y, N229E and N303S | T85L, N190D, H225Y, N229E and N336Q |
| T85L, N190D, H225Y, V258G and A289P | T85L, N190D, H225Y, V258G and N303S | T85L, N190D, H225Y, V258G and N336Q | T85L, N190D, H225Y, A289P and N303S | T85L, N190D, H225Y, A289P and N336Q |
| T85L, N190D, H225Y, N303S and N336Q | T85L, N190D, N229E, V258G and A289P | T85L, N190D, N229E, V258G and N303S | T85L, N190D, N229E, V258G and N336Q | T85L, N190D, N229E, A289P and N303S |
| T85L, N190D, N229E, A289P and N336Q | T85L, N190D, N229E, N303S and N336Q | T85L, N190D, V258G, A289P and N303S | T85L, N190D, V258G, A289P and N336Q | T85L, N190D, V258G, N303S and N336Q |
| T85L, N190D, A289P, N303S and N336Q | T85L, H225Y, N229E, V258G and A289P | T85L, H225Y, N229E, V258G and N303S | T85L, H225Y, N229E, V258G and N336Q | T85L, H225Y, N229E, A289P and N303S |
| T85L, H225Y, N229E, A289P and N336Q | T85L, H225Y, N229E, N303S and N336Q | T85L, H225Y, V258G, A289P and N303S | T85L, H225Y, V258G, A289P and N336Q | T85L, H225Y, V258G, N303S and N336Q |
| T85L, H225Y, A289P, N303S and N336Q | T85L, N229E, V258G, A289P and N303S | T85L, N229E, V258G, A289P and N336Q | T85L, N229E, V258G, N303S and N336Q | T85L, N229E, A289P, N303S and N336Q |
| T85L, V258G, A289P, N303S and N336Q | H121Y, N130K, M134L, E154D and N190D | H121Y, N130K, M134L, E154D and H225Y | H121Y, N130K, M134L, E154D and N229E | H121Y, N130K, M134L, E154D and V258G |
| H121Y, N130K, M134L, E154D and A289P | H121Y, N130K, M134L, E154D and N303S | H121Y, N130K, M134L, E154D and N336Q | H121Y, N130K, M134L, N190D and H225Y | H121Y, N130K, M134L, N190D and N229E |
| H121Y, N130K, M134L, N190D and V258G | H121Y, N130K, M134L, N190D and A289P | H121Y, N130K, M134L, N190D and N303S | H121Y, N130K, M134L, N190D and N336Q | H121Y, N130K, M134L, H225Y and N229E |
| H121Y, N130K, M134L, H225Y and V258G | H121Y, N130K, M134L, H225Y and A289P | H121Y, N130K, M134L, H225Y and N303S | H121Y, N130K, M134L, H225Y and N336Q | H121Y, N130K, M134L, N229E and V258G |

TABLE 21-continued

Non-limiting examples of mutations [as compared to SEQ ID NO: 35]

| | | | | |
|---|---|---|---|---|
| H121Y, N130K, M134L, N229E and A289P | H121Y, N130K, M134L, N229E and N303S | H121Y, N130K, M134L, N229E and N336Q | H121Y, N130K, M134L, V258G and A289P | H121Y, N130K, M134L, V258G and N303S |
| H121Y, N130K, M134L, V258G and N336Q | H121Y, N130K, M134L, A289P and N303S | H121Y, N130K, M134L, A289P and N336Q | H121Y, N130K, M134L, N303S and N336Q | H121Y, N130K, E154D, N190D and H225Y |
| H121Y, N130K, E154D, N190D and N229E | H121Y, N130K, E154D, N190D and V258G | H121Y, N130K, E154D, N190D and A289P | H121Y, N130K, E154D, N190D and N303S | H121Y, N130K, E154D, N190D and N336Q |
| H121Y, N130K, E154D, H225Y and N229E | H121Y, N130K, E154D, H225Y and V258G | H121Y, N130K, E154D, H225Y and A289P | H121Y, N130K, E154D, H225Y and N303S | H121Y, N130K, E154D, H225Y and N336Q |
| H121Y, N130K, E154D, N229E and V258G | H121Y, N130K, E154D, N229E and A289P | H121Y, N130K, E154D, N229E and N303S | H121Y, N130K, E154D, N229E and N336Q | H121Y, N130K, E154D, V258G and A289P |
| H121Y, N130K, E154D, V258G and N303S | H121Y, N130K, E154D, V258G and N336Q | H121Y, N130K, E154D, A289P and N303S | H121Y, N130K, E154D, A289P and N336Q | H121Y, N130K, E154D, N303S and N336Q |
| H121Y, N130K, N190D, H225Y and N229E | H121Y, N130K, N190D, H225Y and V258G | H121Y, N130K, N190D, H225Y and A289P | H121Y, N130K, N190D, H225Y and N303S | H121Y, N130K, N190D, H225Y and N336Q |
| H121Y, N130K, N190D, N229E and V258G | H121Y, N130K, N190D, N229E and A289P | H121Y, N130K, N190D, N229E and N303S | H121Y, N130K, N190D, N229E and N336Q | H121Y, N130K, N190D, V258G and A289P |
| H121Y, N130K, N190D, V258G and N303S | H121Y, N130K, N190D, V258G and N336Q | H121Y, N130K, N190D, A289P and N303S | H121Y, N130K, N190D, A289P and N336Q | H121Y, N130K, N190D, N303S and N336Q |
| H121Y, N130K, H225Y, N229E and V258G | H121Y, N130K, H225Y, N229E and A289P | H121Y, N130K, H225Y, N229E and N303S | H121Y, N130K, H225Y, N229E and N336Q | H121Y, N130K, H225Y, V258G and A289P |
| H121Y, N130K, H225Y, V258G and N303S | H121Y, N130K, H225Y, V258G and N336Q | H121Y, N130K, H225Y, A289P and N303S | H121Y, N130K, H225Y, A289P and N336Q | H121Y, N130K, H225Y, N303S and N336Q |
| H121Y, N130K, N229E, V258G and A289P | H121Y, N130K, N229E, V258G and N303S | H121Y, N130K, N229E, V258G and N336Q | H121Y, N130K, N229E, A289P and N303S | H121Y, N130K, N229E, A289P and N336Q |
| H121Y, N130K, N229E, N303S and N336Q | H121Y, N130K, V258G, A289P and N303S | H121Y, N130K, V258G, A289P and N336Q | H121Y, N130K, V258G, N303S and N336Q | H121Y, N130K, A289P, N303S and N336Q |
| H121Y, M134L, E154D, N190D and H225Y | H121Y, M134L, E154D, N190D and N229E | H121Y, M134L, E154D, N190D and V258G | H121Y, M134L, E154D, N190D and A289P | H121Y, M134L, E154D, N190D and N303S |
| H121Y, M134L, E154D, N190D and N336Q | H121Y, M134L, E154D, H225Y and N229E | H121Y, M134L, E154D, H225Y and V258G | H121Y, M134L, E154D, H225Y and A289P | H121Y, M134L, E154D, H225Y and N303S |
| H121Y, M134L, E154D, H225Y and N336Q | H121Y, M134L, E154D, N229E and V258G | H121Y, M134L, E154D, N229E and A289P | H121Y, M134L, E154D, N229E and N303S | H121Y, M134L, E154D, N229E and N336Q |
| H121Y, M134L, E154D, V258G and A289P | H121Y, M134L, E154D, V258G and N303S | H121Y, M134L, E154D, V258G and N336Q | H121Y, M134L, E154D, A289P and N303S | H121Y, M134L, E154D, A289P and N336Q |
| H121Y, M134L, E154D, N303S and N336Q | H121Y, M134L, N190D, H225Y and N229E | H121Y, M134L, N190D, H225Y and V258G | H121Y, M134L, N190D, H225Y and A289P | H121Y, M134L, N190D, H225Y and N303S |
| H121Y, M134L, N190D, H225Y and N336Q | H121Y, M134L, N190D, N229E and V258G | H121Y, M134L, N190D, N229E and A289P | H121Y, M134L, N190D, N229E and N303S | H121Y, M134L, N190D, N229E and N336Q |
| H121Y, M134L, N190D, V258G and A289P | H121Y, M134L, N190D, V258G and N303S | H121Y, M134L, N190D, V258G and N336Q | H121Y, M134L, N190D, A289P and N303S | H121Y, M134L, N190D, A289P and N336Q |
| H121Y, M134L, N190D, N303S and N336Q | H121Y, M134L, H225Y, N229E and V258G | H121Y, M134L, H225Y, N229E and A289P | H121Y, M134L, H225Y, N229E and N303S | H121Y, M134L, H225Y, N229E and N336Q |
| H121Y, M134L, H225Y, V258G and A289P | H121Y, M134L, H225Y, V258G and N303S | H121Y, M134L, H225Y, V258G and N336Q | H121Y, M134L, H225Y, A289P and N303S | H121Y, M134L, H225Y, A289P and N336Q |
| H121Y, M134L, H225Y, N303S and N336Q | H121Y, M134L, N229E, V258G and A289P | H121Y, M134L, N229E, V258G and N303S | H121Y, M134L, N229E, V258G and N336Q | H121Y, M134L, N229E, A289P and N303S |
| H121Y, M134L, N229E, A289P and N336Q | H121Y, M134L, N229E, N303S and N336Q | H121Y, M134L, V258G, A289P and N303S | H121Y, M134L, V258G, A289P and N336Q | H121Y, M134L, V258G, N303S and N336Q |
| H121Y, M134L, A289P, N303S and N336Q | H121Y, E154D, N190D, H225Y and N229E | H121Y, E154D, N190D, H225Y and V258G | H121Y, E154D, N190D, H225Y and A289P | H121Y, E154D, N190D, H225Y and N303S |
| H121Y, E154D, N190D, H225Y and N336Q | H121Y, E154D, N190D, N229E and V258G | H121Y, E154D, N190D, N229E and A289P | H121Y, E154D, N190D, N229E and N303S | H121Y, E154D, N190D, N229E and N336Q |
| H121Y, E154D, N190D, V258G and A289P | H121Y, E154D, N190D, V258G and N303S | H121Y, E154D, N190D, V258G and N336Q | H121Y, E154D, N190D, A289P and N303S | H121Y, E154D, N190D, A289P and N336Q |
| H121Y, E154D, N190D, N303S and N336Q | H121Y, E154D, H225Y, N229E and V258G | H121Y, E154D, H225Y, N229E and A289P | H121Y, E154D, H225Y, N229E and N303S | H121Y, E154D, H225Y, N229E and N336Q |
| H121Y, E154D, H225Y, V258G and A289P | H121Y, E154D, H225Y, V258G and N303S | H121Y, E154D, H225Y, V258G and N336Q | H121Y, E154D, H225Y, A289P and N303S | H121Y, E154D, H225Y, A289P and N336Q |
| H121Y, E154D, H225Y, N303S and N336Q | H121Y, E154D, N229E, V258G and A289P | H121Y, E154D, N229E, V258G and N303S | H121Y, E154D, N229E, V258G and N336Q | H121Y, E154D, N229E, A289P and N303S |
| H121Y, E154D, N229E, A289P and N336Q | H121Y, E154D, N229E, N303S and N336Q | H121Y, E154D, V258G, A289P and N303S | H121Y, E154D, V258G, A289P and N336Q | H121Y, E154D, V258G, N303S and N336Q |
| H121Y, E154D, A289P, N303S and N336Q | H121Y, N190D, H225Y, N229E and V258G | H121Y, N190D, H225Y, N229E and A289P | H121Y, N190D, H225Y, N229E and N303S | H121Y, N190D, H225Y, N229E and N336Q |
| H121Y, N190D, H225Y, V258G and A289P | H121Y, N190D, H225Y, V258G and N303S | H121Y, N190D, H225Y, V258G and N336Q | H121Y, N190D, H225Y, A289P and N303S | H121Y, N190D, H225Y, A289P and N336Q |
| H121Y, N190D, H225Y, N303S and N336Q | H121Y, N190D, N229E, V258G and A289P | H121Y, N190D, N229E, V258G and N303S | H121Y, N190D, N229E, V258G and N336Q | H121Y, N190D, N229E, A289P and N303S |
| H121Y, N190D, N229E, A289P and N336Q | H121Y, N190D, N229E, N303S and N336Q | H121Y, N190D, V258G, A289P and N303S | H121Y, N190D, V258G, A289P and N336Q | H121Y, N190D, V258G, N303S and N336Q |
| H121Y, N190D, A289P, N303S and N336Q | H121Y, H225Y, N229E, V258G and A289P | H121Y, H225Y, N229E, V258G and N303S | H121Y, H225Y, N229E, V258G and N336Q | H121Y, H225Y, N229E, A289P and N303S |
| H121Y, H225Y, N229E, A289P and N336Q | H121Y, H225Y, N229E, N303S and N336Q | H121Y, H225Y, V258G, A289P and N303S | H121Y, H225Y, V258G, A289P and N336Q | H121Y, H225Y, V258G, N303S and N336Q |
| H121Y, H225Y, A289P, N303S and N336Q | H121Y, N229E, V258G, A289P and N303S | H121Y, N229E, V258G, A289P and N336Q | H121Y, N229E, V258G, N303S and N336Q | H121Y, N229E, A289P, N303S and N336Q |
| H121Y, V258G, A289P, N303S and N336Q | N130K, M134L, E154D, N190D and H225Y | N130K, M134L, E154D, N190D and N229E | N130K, M134L, E154D, N190D and V258G | N130K, M134L, E154D, N190D and A289P |

TABLE 21-continued

Non-limiting examples of mutations [as compared to SEQ ID NO: 35]

| | | | | |
|---|---|---|---|---|
| N130K, M134L, E154D, N190D and N303S | N130K, M134L, E154D, N190D and N336Q | N130K, M134L, E154D, H225Y and N229E | N130K, M134L, E154D, H225Y and V258G | N130K, M134L, E154D, H225Y and A289P |
| N130K, M134L, E154D, H225Y and N303S | N130K, M134L, E154D, H225Y and N336Q | N130K, M134L, E154D, N229E and V258G | N130K, M134L, E154D, N229E and A289P | N130K, M134L, E154D, N229E and N303S |
| N130K, M134L, E154D, N229E and N336Q | N130K, M134L, E154D, V258G and A289P | N130K, M134L, E154D, V258G and N303S | N130K, M134L, E154D, V258G and N336Q | N130K, M134L, E154D, A289P and N303S |
| N130K, M134L, E154D, A289P and N336Q | N130K, M134L, E154D, N303S and N336Q | N130K, M134L, N190D, H225Y and N229E | N130K, M134L, N190D, H225Y and V258G | N130K, M134L, N190D, H225Y and A289P |
| N130K, M134L, N190D, H225Y and N303S | N130K, M134L, N190D, H225Y and N336Q | N130K, M134L, N190D, N229E and V258G | N130K, M134L, N190D, N229E and A289P | N130K, M134L, N190D, N229E and N303S |
| N130K, M134L, N190D, N229E and N336Q | N130K, M134L, N190D, V258G and A289P | N130K, M134L, N190D, V258G and N303S | N130K, M134L, N190D, V258G and N336Q | N130K, M134L, N190D, A289P and N303S |
| N130K, M134L, N190D, A289P and N336Q | N130K, M134L, N190D, N303S and N336Q | N130K, M134L, H225Y, N229E and V258G | N130K, M134L, H225Y, N229E and A289P | N130K, M134L, H225Y, N229E and N303S |
| N130K, M134L, H225Y, N229E and N336Q | N130K, M134L, H225Y, V258G and A289P | N130K, M134L, H225Y, V258G and N303S | N130K, M134L, H225Y, V258G and N336Q | N130K, M134L, H225Y, A289P and N303S |
| N130K, M134L, H225Y, A289P and N336Q | N130K, M134L, H225Y, N303S and N336Q | N130K, M134L, N229E, V258G and A289P | N130K, M134L, N229E, V258G and N303S | N130K, M134L, N229E, V258G and N336Q |
| N130K, M134L, N229E, A289P and N303S | N130K, M134L, N229E, A289P and N336Q | N130K, M134L, N229E, N303S and N336Q | N130K, M134L, V258G, A289P and N303S | N130K, M134L, V258G, A289P and N336Q |
| N130K, M134L, V258G, N303S and N336Q | N130K, M134L, A289P, N303S and N336Q | N130K, E154D, N190D, H225Y and N229E | N130K, E154D, N190D, H225Y and V258G | N130K, E154D, N190D, H225Y and A289P |
| N130K, E154D, N190D, H225Y and N303S | N130K, E154D, N190D, H225Y and N336Q | N130K, E154D, N190D, N229E and V258G | N130K, E154D, N190D, N229E and A289P | N130K, E154D, N190D, N229E and N303S |
| N130K, E154D, N190D, N229E and N336Q | N130K, E154D, N190D, V258G and A289P | N130K, E154D, N190D, V258G and N303S | N130K, E154D, N190D, V258G and N336Q | N130K, E154D, N190D, A289P and N303S |
| N130K, E154D, N190D, A289P and N336Q | N130K, E154D, N190D, N303S and N336Q | N130K, E154D, H225Y, N229E and V258G | N130K, E154D, H225Y, N229E and A289P | N130K, E154D, H225Y, N229E and N303S |
| N130K, E154D, H225Y, N229E and N336Q | N130K, E154D, H225Y, V258G and A289P | N130K, E154D, H225Y, V258G and N303S | N130K, E154D, H225Y, V258G and N336Q | N130K, E154D, H225Y, A289P and N303S |
| N130K, E154D, H225Y, A289P and N336Q | N130K, E154D, H225Y, N303S and N336Q | N130K, E154D, N229E, V258G and A289P | N130K, E154D, N229E, V258G and N303S | N130K, E154D, N229E, V258G and N336Q |
| N130K, E154D, N229E, A289P and N303S | N130K, E154D, N229E, A289P and N336Q | N130K, E154D, N229E, N303S and N336Q | N130K, E154D, V258G, A289P and N303S | N130K, E154D, V258G, A289P and N336Q |
| N130K, E154D, V258G, N303S and N336Q | N130K, E154D, A289P, N303S and N336Q | N130K, N190D, H225Y, N229E and V258G | N130K, N190D, H225Y, N229E and A289P | N130K, N190D, H225Y, N229E and N303S |
| N130K, N190D, H225Y, N229E and N336Q | N130K, N190D, H225Y, V258G and A289P | N130K, N190D, H225Y, V258G and N303S | N130K, N190D, H225Y, V258G and N336Q | N130K, N190D, H225Y, A289P and N303S |
| N130K, N190D, H225Y, A289P and N336Q | N130K, N190D, H225Y, N303S and N336Q | N130K, N190D, N229E, V258G and A289P | N130K, N190D, N229E, V258G and N303S | N130K, N190D, N229E, V258G and N336Q |
| N130K, N190D, N229E, A289P and N303S | N130K, N190D, N229E, A289P and N336Q | N130K, N190D, N229E, N303S and N336Q | N130K, N190D, V258G, A289P and N303S | N130K, N190D, V258G, A289P and N336Q |
| N130K, N190D, V258G, N303S and N336Q | N130K, N190D, A289P, N303S and N336Q | N130K, H225Y, N229E, V258G and A289P | N130K, H225Y, N229E, V258G and N303S | N130K, H225Y, N229E, V258G and N336Q |
| N130K, H225Y, N229E, A289P and N303S | N130K, H225Y, N229E, A289P and N336Q | N130K, H225Y, N229E, N303S and N336Q | N130K, H225Y, V258G, A289P and N303S | N130K, H225Y, V258G, A289P and N336Q |
| N130K, H225Y, V258G, N303S and N336Q | N130K, H225Y, A289P, N303S and N336Q | N130K, N229E, V258G, A289P and N303S | N130K, N229E, V258G, A289P and N336Q | N130K, N229E, V258G, N303S and N336Q |
| N130K, N229E, A289P, N303S and N336Q | N130K, V258G, A289P, N303S and N336Q | M134L, E154D, N190D, H225Y and N229E | M134L, E154D, N190D, H225Y and V258G | M134L, E154D, N190D, H225Y and A289P |
| M134L, E154D, N190D, H225Y and N303S | M134L, E154D, N190D, H225Y and N336Q | M134L, E154D, N190D, N229E and V258G | M134L, E154D, N190D, N229E and A289P | M134L, E154D, N190D, N229E and N303S |
| M134L, E154D, N190D, N229E and N336Q | M134L, E154D, N190D, V258G and A289P | M134L, E154D, N190D, V258G and N303S | M134L, E154D, N190D, V258G and N336Q | M134L, E154D, N190D, A289P and N303S |
| M134L, E154D, N190D, A289P and N336Q | M134L, E154D, N190D, N303S and N336Q | M134L, E154D, H225Y, N229E and V258G | M134L, E154D, H225Y, N229E and A289P | M134L, E154D, H225Y, N229E and N303S |
| M134L, E154D, H225Y, N229E and N336Q | M134L, E154D, H225Y, V258G and A289P | M134L, E154D, H225Y, V258G and N303S | M134L, E154D, H225Y, V258G and N336Q | M134L, E154D, H225Y, A289P and N303S |
| M134L, E154D, H225Y, A289P and N336Q | M134L, E154D, H225Y, N303S and N336Q | M134L, E154D, N229E, V258G and A289P | M134L, E154D, N229E, V258G and N303S | M134L, E154D, N229E, V258G and N336Q |
| M134L, E154D, N229E, A289P and N303S | M134L, E154D, N229E, A289P and N336Q | M134L, E154D, N229E, N303S and N336Q | M134L, E154D, V258G, A289P and N303S | M134L, E154D, V258G, A289P and N336Q |
| M134L, E154D, V258G, N303S and N336Q | M134L, E154D, A289P, N303S and N336Q | M134L, N190D, H225Y, N229E and V258G | M134L, N190D, H225Y, N229E and A289P | M134L, N190D, H225Y, N229E and N303S |
| M134L, N190D, H225Y, N229E and N336Q | M134L, N190D, H225Y, V258G and A289P | M134L, N190D, H225Y, V258G and N303S | M134L, N190D, H225Y, V258G and N336Q | M134L, N190D, H225Y, A289P and N303S |
| M134L, N190D, H225Y, A289P and N336Q | M134L, N190D, H225Y, N303S and N336Q | M134L, N190D, N229E, V258G and A289P | M134L, N190D, N229E, V258G and N303S | M134L, N190D, N229E, V258G and N336Q |
| M134L, N190D, N229E, A289P and N303S | M134L, N190D, N229E, A289P and N336Q | M134L, N190D, N229E, N303S and N336Q | M134L, N190D, V258G, A289P and N303S | M134L, N190D, V258G, A289P and N336Q |
| M134L, N190D, V258G, N303S and N336Q | M134L, N190D, A289P, N303S and N336Q | M134L, H225Y, N229E, V258G and A289P | M134L, H225Y, N229E, V258G and N303S | M134L, H225Y, N229E, V258G and N336Q |
| M134L, H225Y, N229E, A289P and N303S | M134L, H225Y, N229E, A289P and N336Q | M134L, H225Y, N229E, N303S and N336Q | M134L, H225Y, V258G, A289P and N303S | M134L, H225Y, V258G, A289P and N336Q |
| M134L, H225Y, V258G, N303S and N336Q | M134L, H225Y, A289P, N303S and N336Q | M134L, N229E, V258G, A289P and N303S | M134L, N229E, V258G, A289P and N336Q | M134L, N229E, V258G, N303S and N336Q |
| M134L, N229E, A289P, N303S and N336Q | M134L, V258G, A289P, N303S and N336Q | E154D, N190D, H225Y, N229E and V258G | E154D, N190D, H225Y, N229E and A289P | E154D, N190D, H225Y, N229E and N303S |

TABLE 21-continued

| Non-limiting examples of mutations [as compared to SEQ ID NO: 35] | | | | |
|---|---|---|---|---|
| E154D, N190D, H225Y, N229E and N336Q | E154D, N190D, H225Y, V258G and N303S | E154D, N190D, H225Y, V258G and N336Q | E154D, N190D, H225Y, V258G and N336Q | E154D, N190D, H225Y, A289P and N303S |
| E154D, N190D, H225Y, A289P and N336Q | E154D, N190D, H225Y, N303S and N336Q | E154D, N190D, N229E, V258G and A289P | E154D, N190D, N229E, V258G and N303S | E154D, N190D, N229E, V258G and N336Q |
| E154D, N190D, N229E, A289P and N303S | E154D, N190D, N229E, A289P and N336Q | E154D, N190D, N229E, N303S and N336Q | E154D, N190D, V258G, A289P and N303S | E154D, N190D, V258G, A289P and N336Q |
| E154D, N190D, V258G, N303S and N336Q | E154D, N190D, A289P, N303S and N336Q | E154D, H225Y, N229E, V258G and A289P | E154D, H225Y, N229E, V258G and N303S | E154D, H225Y, N229E, V258G and N336Q |
| E154D, H225Y, N229E, A289P and N303S | E154D, H225Y, N229E, A289P and N336Q | E154D, H225Y, N229E, N303S and N336Q | E154D, H225Y, V258G, A289P and N303S | E154D, H225Y, V258G, A289P and N336Q |
| E154D, H225Y, V258G, N303S and N336Q | E154D, H225Y, A289P, N303S and N336Q | E154D, N229E, V258G, A289P and N303S | E154D, N229E, V258G, A289P and N336Q | E154D, N229E, V258G, N303S and N336Q |
| E154D, N229E, A289P, N303S and N336Q | E154D, V258G, A289P, N303S and N336Q | N190D, H225Y, N229E, V258G and A289P | N190D, H225Y, N229E, V258G and N303S | N190D, H225Y, N229E, V258G and N336Q |
| N190D, H225Y, N229E, A289P and N303S | N190D, H225Y, N229E, A289P and N336Q | N190D, H225Y, N229E, N303S and N336Q | N190D, H225Y, V258G, A289P and N303S | N190D, H225Y, V258G, A289P and N336Q |
| N190D, H225Y, V258G, N303S and N336Q | N190D, H225Y, A289P, N303S and N336Q | N190D, N229E, V258G, A289P and N303S | N190D, N229E, V258G, A289P and N336Q | N190D, N229E, V258G, N303S and N336Q |
| N190D, N229E, A289P, N303S and N336Q | N190D, V258G, A289P, N303S and N336Q | H225Y, N229E, V258G, A289P and N303S | H225Y, N229E, V258G, A289P and N336Q | H225Y, N229E, V258G, N303S and N336Q |
| H225Y, N229E, A289P, N303S and N336Q | H225Y, V258G, A289P, N303S and N336Q | N229E, V258G, A289P, N303S and N336Q | | |
| T85L, H121Y, N130K, M134L, E154D and N190D | T85L, H121Y, N130K, M134L, E154D and H225Y | T85L, H121Y, N130K, M134L, E154D and N229E | T85L, H121Y, N130K, M134L, E154D and V258G | T85L, H121Y, N130K, M134L, E154D and A289P |
| T85L, H121Y, N130K, M134L, E154D and N303S | T85L, H121Y, N130K, M134L, E154D and N336Q | T85L, H121Y, N130K, M134L, N190D and H225Y | T85L, H121Y, N130K, M134L, N190D and N229E | T85L, H121Y, N130K, M134L, N190D and V258G |
| T85L, H121Y, N130K, M134L, N190D and A289P | T85L, H121Y, N130K, M134L, N190D and N303S | T85L, H121Y, N130K, M134L, N190D and N336Q | T85L, H121Y, N130K, M134L, H225Y and N229E | T85L, H121Y, N130K, M134L, H225Y and V258G |
| T85L, H121Y, N130K, M134L, H225Y and A289P | T85L, H121Y, N130K, M134L, H225Y and N303S | T85L, H121Y, N130K, M134L, H225Y and N336Q | T85L, H121Y, N130K, M134L, N229E and V258G | T85L, H121Y, N130K, M134L, N229E and A289P |
| T85L, H121Y, N130K, M134L, N229E and N303S | T85L, H121Y, N130K, M134L, N229E and N336Q | T85L, H121Y, N130K, M134L, V258G and A289P | T85L, H121Y, N130K, M134L, V258G and N303S | T85L, H121Y, N130K, M134L, V258G and N336Q |
| T85L, H121Y, N130K, M134L, A289P and N303S | T85L, H121Y, N130K, M134L, A289P and N336Q | T85L, H121Y, N130K, M134L, N303S and N336Q | T85L, H121Y, N130K, E154D, N190D and H225Y | T85L, H121Y, N130K, E154D, N190D and N229E |
| T85L, H121Y, N130K, E154D, N190D and V258G | T85L, H121Y, N130K, E154D, N190D and A289P | T85L, H121Y, N130K, E154D, N190D and N303S | T85L, H121Y, N130K, E154D, N190D and N336Q | T85L, H121Y, N130K, E154D, H225Y and N229E |
| T85L, H121Y, N130K, E154D, H225Y and V258G | T85L, H121Y, N130K, E154D, H225Y and A289P | T85L, H121Y, N130K, E154D, H225Y and N303S | T85L, H121Y, N130K, E154D, H225Y and N336Q | T85L, H121Y, N130K, E154D, N229E and V258G |
| T85L, H121Y, N130K, E154D, N229E and A289P | T85L, H121Y, N130K, E154D, N229E and N303S | T85L, H121Y, N130K, E154D, N229E and N336Q | T85L, H121Y, N130K, E154D, V258G and A289P | T85L, H121Y, N130K, E154D, V258G and N303S |
| T85L, H121Y, N130K, E154D, V258G and N336Q | T85L, H121Y, N130K, E154D, A289P and N303S | T85L, H121Y, N130K, E154D, A289P and N336Q | T85L, H121Y, N130K, E154D, N303S and N336Q | T85L, H121Y, N130K, N190D, H225Y and N229E |
| T85L, H121Y, N130K, N190D, H225Y and V258G | T85L, H121Y, N130K, N190D, H225Y and A289P | T85L, H121Y, N130K, N190D, H225Y and N303S | T85L, H121Y, N130K, N190D, H225Y and N336Q | T85L, H121Y, N130K, N190D, N229E and V258G |
| T85L, H121Y, N130K, N190D, N229E and A289P | T85L, H121Y, N130K, N190D, N229E and N303S | T85L, H121Y, N130K, N190D, N229E and N336Q | T85L, H121Y, N130K, N190D, V258G and A289P | T85L, H121Y, N130K, N190D, V258G and N303S |
| T85L, H121Y, N130K, N190D, V258G and N336Q | T85L, H121Y, N130K, N190D, A289P and N303S | T85L, H121Y, N130K, N190D, A289P and N336Q | T85L, H121Y, N130K, N190D, N303S and N336Q | T85L, H121Y, N130K, H225Y, N229E and V258G |
| T85L, H121Y, N130K, H225Y, N229E and A289P | T85L, H121Y, N130K, H225Y, N229E and N303S | T85L, H121Y, N130K, H225Y, N229E and N336Q | T85L, H121Y, N130K, H225Y, V258G and A289P | T85L, H121Y, N130K, H225Y, V258G and N303S |
| T85L, H121Y, N130K, H225Y, V258G and N336Q | T85L, H121Y, N130K, H225Y, A289P and N303S | T85L, H121Y, N130K, H225Y, A289P and N336Q | T85L, H121Y, N130K, H225Y, N303S and N336Q | T85L, H121Y, N130K, N229E, V258G and A289P |
| T85L, H121Y, N130K, N229E, V258G and N303S | T85L, H121Y, N130K, N229E, V258G and N336Q | T85L, H121Y, N130K, N229E, A289P and N303S | T85L, H121Y, N130K, N229E, A289P and N336Q | T85L, H121Y, N130K, N229E, N303S and N336Q |
| T85L, H121Y, N130K, V258G, A289P and N303S | T85L, H121Y, N130K, V258G, A289P and N336Q | T85L, H121Y, N130K, V258G, N303S and N336Q | T85L, H121Y, N130K, A289P, N303S and N336Q | T85L, H121Y, M134L, E154D, N190D and H225Y |
| T85L, H121Y, M134L, E154D, N190D and N229E | T85L, H121Y, M134L, E154D, N190D and V258G | T85L, H121Y, M134L, E154D, N190D and A289P | T85L, H121Y, M134L, E154D, N190D and N303S | T85L, H121Y, M134L, E154D, N190D and N336Q |

TABLE 21-continued

Non-limiting examples of mutations [as compared to SEQ ID NO: 35]

| | | | | |
|---|---|---|---|---|
| T85L, H121Y, M134L, E154D, H225Y and N229E | T85L, H121Y, M134L, E154D, H225Y and V258G | T85L, H121Y, M134L, E154D, H225Y and A289P | T85L, H121Y, M134L, E154D, H225Y and N303S | T85L, H121Y, M134L, E154D, H225Y and N336Q |
| T85L, H121Y, M134L, E154D, N229E and V258G | T85L, H121Y, M134L, E154D, N229E and A289P | T85L, H121Y, M134L, E154D, N229E and N303S | T85L, H121Y, M134L, E154D, N229E and N336Q | T85L, H121Y, M134L, E154D, V258G and A289P |
| T85L, H121Y, M134L, E154D, V258G and N303S | T85L, H121Y, M134L, E154D, V258G and N336Q | T85L, H121Y, M134L, E154D, A289P and N303S | T85L, H121Y, M134L, E154D, A289P and N336Q | T85L, H121Y, M134L, E154D, N303S and N336Q |
| T85L, H121Y, M134L, N190D, H225Y and N229E | T85L, H121Y, M134L, N190D, H225Y and V258G | T85L, H121Y, M134L, N190D, H225Y and A289P | T85L, H121Y, M134L, N190D, H225Y and N303S | T85L, H121Y, M134L, N190D, H225Y and N336Q |
| T85L, H121Y, M134L, N190D, N229E and V258G | T85L, H121Y, M134L, N190D, N229E and A289P | T85L, H121Y, M134L, N190D, N229E and N303S | T85L, H121Y, M134L, N190D, N229E and N336Q | T85L, H121Y, M134L, N190D, V258G and A289P |
| T85L, H121Y, M134L, N190D, V258G and N303S | T85L, H121Y, M134L, N190D, V258G and N336Q | T85L, H121Y, M134L, N190D, A289P and N303S | T85L, H121Y, M134L, N190D, A289P and N336Q | T85L, H121Y, M134L, N190D, N303S and N336Q |
| T85L, H121Y, M134L, H225Y, N229E and V258G | T85L, H121Y, M134L, H225Y, N229E and A289P | T85L, H121Y, M134L, H225Y, N229E and N303S | T85L, H121Y, M134L, H225Y, N229E and N336Q | T85L, H121Y, M134L, H225Y, V258G and A289P |
| T85L, H121Y, M134L, H225Y, V258G and N303S | T85L, H121Y, M134L, H225Y, V258G and N336Q | T85L, H121Y, M134L, H225Y, A289P and N303S | T85L, H121Y, M134L, H225Y, A289P and N336Q | T85L, H121Y, M134L, H225Y, N303S and N336Q |
| T85L, H121Y, M134L, N229E, V258G and A289P | T85L, H121Y, M134L, N229E, V258G and N303S | T85L, H121Y, M134L, N229E, V258G and N336Q | T85L, H121Y, M134L, N229E, A289P and N303S | T85L, H121Y, M134L, N229E, A289P and N336Q |
| T85L, H121Y, M134L, N229E, N303S and N336Q | T85L, H121Y, M134L, V258G, A289P and N303S | T85L, H121Y, M134L, V258G, A289P and N336Q | T85L, H121Y, M134L, V258G, N303S and N336Q | T85L, H121Y, M134L, A289P, N303S and N336Q |
| T85L, H121Y, E154D, N190D, H225Y and N229E | T85L, H121Y, E154D, N190D, H225Y and V258G | T85L, H121Y, E154D, N190D, H225Y and A289P | T85L, H121Y, E154D, N190D, H225Y and N303S | T85L, H121Y, E154D, N190D, H225Y and N336Q |
| T85L, H121Y, E154D, N190D, N229E and V258G | T85L, H121Y, E154D, N190D, N229E and A289P | T85L, H121Y, E154D, N190D, N229E and N303S | T85L, H121Y, E154D, N190D, N229E and N336Q | T85L, H121Y, E154D, N190D, V258G and A289P |
| T85L, H121Y, E154D, N190D, V258G and N303S | T85L, H121Y, E154D, N190D, V258G and N336Q | T85L, H121Y, E154D, N190D, A289P and N303S | T85L, H121Y, E154D, N190D, A289P and N336Q | T85L, H121Y, E154D, N190D, N303S and N336Q |
| T85L, H121Y, E154D, H225Y, N229E and V258G | T85L, H121Y, E154D, H225Y, N229E and A289P | T85L, H121Y, E154D, H225Y, N229E and N303S | T85L, H121Y, E154D, H225Y, N229E and N336Q | T85L, H121Y, E154D, H225Y, V258G and A289P |
| T85L, H121Y, E154D, H225Y, V258G and N303S | T85L, H121Y, E154D, H225Y, V258G and N336Q | T85L, H121Y, E154D, H225Y, A289P and N303S | T85L, H121Y, E154D, H225Y, A289P and N336Q | T85L, H121Y, E154D, H225Y, N303S and N336Q |
| T85L, H121Y, E154D, N229E, V258G and A289P | T85L, H121Y, E154D, N229E, V258G and N303S | T85L, H121Y, E154D, N229E, V258G and N336Q | T85L, H121Y, E154D, N229E, A289P and N303S | T85L, H121Y, E154D, N229E, A289P and N336Q |
| T85L, H121Y, E154D, N229E, N303S and N336Q | T85L, H121Y, E154D, V258G, A289P and N303S | T85L, H121Y, E154D, V258G, A289P and N336Q | T85L, H121Y, E154D, V258G, N303S and N336Q | T85L, H121Y, E154D, A289P, N303S and N336Q |
| T85L, H121Y, N190D, H225Y, N229E and V258G | T85L, H121Y, N190D, H225Y, N229E and A289P | T85L, H121Y, N190D, H225Y, N229E and N303S | T85L, H121Y, N190D, H225Y, N229E and N336Q | T85L, H121Y, N190D, H225Y, V258G and A289P |
| T85L, H121Y, N190D, H225Y, V258G and N303S | T85L, H121Y, N190D, H225Y, V258G and N336Q | T85L, H121Y, N190D, H225Y, A289P and N303S | T85L, H121Y, N190D, H225Y, A289P and N336Q | T85L, H121Y, N190D, H225Y, N303S and N336Q |
| T85L, H121Y, N190D, N229E, V258G and A289P | T85L, H121Y, N190D, N229E, V258G and N303S | T85L, H121Y, N190D, N229E, V258G and N336Q | T85L, H121Y, N190D, N229E, A289P and N303S | T85L, H121Y, N190D, N229E, A289P and N336Q |
| T85L, H121Y, N190D, N229E, N303S and N336Q | T85L, H121Y, N190D, V258G, A289P and N303S | T85L, H121Y, N190D, V258G, A289P and N336Q | T85L, H121Y, N190D, V258G, N303S and N336Q | T85L, H121Y, N190D, A289P, N303S and N336Q |
| T85L, H121Y, H225Y, N229E, V258G and A289P | T85L, H121Y, H225Y, N229E, V258G and N303S | T85L, H121Y, H225Y, N229E, V258G and N336Q | T85L, H121Y, H225Y, N229E, A289P and N303S | T85L, H121Y, H225Y, N229E, A289P and N336Q |
| T85L, H121Y, H225Y, N229E, N303S and N336Q | T85L, H121Y, H225Y, V258G, A289P and N303S | T85L, H121Y, H225Y, V258G, A289P and N336Q | T85L, H121Y, H225Y, V258G, N303S and N336Q | T85L, H121Y, H225Y, A289P, N303S and N336Q |
| T85L, H121Y, N229E, V258G, A289P and N303S | T85L, H121Y, N229E, V258G, A289P and N336Q | T85L, H121Y, N229E, V258G, N303S and N336Q | T85L, H121Y, N229E, A289P, N303S and N336Q | T85L, H121Y, V258G, A289P, N303S and N336Q |
| T85L, N130K, M134L, E154D, N190D and H225Y | T85L, N130K, M134L, E154D, N190D and N229E | T85L, N130K, M134L, E154D, N190D and V258G | T85L, N130K, M134L, E154D, N190D and A289P | T85L, N130K, M134L, E154D, N190D and N303S |
| T85L, N130K, M134L, E154D, N190D and N336Q | T85L, N130K, M134L, E154D, H225Y and N229E | T85L, N130K, M134L, E154D, H225Y and V258G | T85L, N130K, M134L, E154D, H225Y and A289P | T85L, N130K, M134L, E154D, H225Y and N303S |

TABLE 21-continued

| Non-limiting examples of mutations [as compared to SEQ ID NO: 35] | | | | |
|---|---|---|---|---|
| T85L, N130K, M134L, E154D, H225Y and N336Q | T85L, N130K, M134L, E154D, N229E and V258G | T85L, N130K, M134L, E154D, N229E and A289P | T85L, N130K, M134L, E154D, N229E and N303S | T85L, N130K, M134L, E154D, N229E and N336Q |
| T85L, N130K, M134L, E154D, V258G and A289P | T85L, N130K, M134L, E154D, V258G and N303S | T85L, N130K, M134L, E154D, V258G and N336Q | T85L, N130K, M134L, E154D, A289P and N303S | T85L, N130K, M134L, E154D, A289P and N336Q |
| T85L, N130K, M134L, E154D, N303S and N336Q | T85L, N130K, M134L, N190D, H225Y and N229E | T85L, N130K, M134L, N190D, H225Y and V258G | T85L, N130K, M134L, N190D, H225Y and A289P | T85L, N130K, M134L, N190D, H225Y and N303S |
| T85L, N130K, M134L, N190D, H225Y and N336Q | T85L, N130K, M134L, N190D, N229E and V258G | T85L, N130K, M134L, N190D, N229E and A289P | T85L, N130K, M134L, N190D, N229E and N303S | T85L, N130K, M134L, N190D, N229E and N336Q |
| T85L, N130K, M134L, N190D, V258G and A289P | T85L, N130K, M134L, N190D, V258G and N303S | T85L, N130K, M134L, N190D, V258G and N336Q | T85L, N130K, M134L, N190D, A289P and N303S | T85L, N130K, M134L, N190D, A289P and N336Q |
| T85L, N130K, M134L, N190D, N303S and N336Q | T85L, N130K, M134L, H225Y, N229E and V258G | T85L, N130K, M134L, H225Y, N229E and A289P | T85L, N130K, M134L, H225Y, N229E and N303S | T85L, N130K, M134L, H225Y, N229E and N336Q |
| T85L, N130K, M134L, H225Y, V258G and A289P | T85L, N130K, M134L, H225Y, V258G and N303S | T85L, N130K, M134L, H225Y, V258G and N336Q | T85L, N130K, M134L, H225Y, A289P and N303S | T85L, N130K, M134L, H225Y, A289P and N336Q |
| T85L, N130K, M134L, H225Y, N303S and N336Q | T85L, N130K, M134L, N229E, V258G and A289P | T85L, N130K, M134L, N229E, V258G and N303S | T85L, N130K, M134L, N229E, V258G and N336Q | T85L, N130K, M134L, N229E, A289P and N303S |
| T85L, N130K, M134L, N229E, A289P and N336Q | T85L, N130K, M134L, N229E, N303S and N336Q | T85L, N130K, M134L, V258G, A289P and N303S | T85L, N130K, M134L, V258G, A289P and N336Q | T85L, N130K, M134L, V258G, N303S and N336Q |
| T85L, N130K, M134L, A289P, N303S and N336Q | T85L, N130K, E154D, N190D, H225Y and N229E | T85L, N130K, E154D, N190D, H225Y and V258G | T85L, N130K, E154D, N190D, H225Y and A289P | T85L, N130K, E154D, N190D, H225Y and N303S |
| T85L, N130K, E154D, N190D, H225Y and N336Q | T85L, N130K, E154D, N190D, N229E and V258G | T85L, N130K, E154D, N190D, N229E and A289P | T85L, N130K, E154D, N190D, N229E and N303S | T85L, N130K, E154D, N190D, N229E and N336Q |
| T85L, N130K, E154D, N190D, V258G and A289P | T85L, N130K, E154D, N190D, V258G and N303S | T85L, N130K, E154D, N190D, V258G and N336Q | T85L, N130K, E154D, N190D, A289P and N303S | T85L, N130K, E154D, N190D, A289P and N336Q |
| T85L, N130K, E154D, N190D, N303S and N336Q | T85L, N130K, E154D, H225Y, N229E and V258G | T85L, N130K, E154D, H225Y, N229E and A289P | T85L, N130K, E154D, H225Y, N229E and N303S | T85L, N130K, E154D, H225Y, N229E and N336Q |
| T85L, N130K, E154D, H225Y, V258G and A289P | T85L, N130K, E154D, H225Y, V258G and N303S | T85L, N130K, E154D, H225Y, V258G and N336Q | T85L, N130K, E154D, H225Y, A289P and N303S | T85L, N130K, E154D, H225Y, A289P and N336Q |
| T85L, N130K, E154D, H225Y, N303S and N336Q | T85L, N130K, E154D, N229E, V258G and A289P | T85L, N130K, E154D, N229E, V258G and N303S | T85L, N130K, E154D, N229E, V258G and N336Q | T85L, N130K, E154D, N229E, A289P and N303S |
| T85L, N130K, E154D, N229E, A289P and N336Q | T85L, N130K, E154D, N229E, N303S and N336Q | T85L, N130K, E154D, V258G, A289P and N303S | T85L, N130K, E154D, V258G, A289P and N336Q | T85L, N130K, E154D, V258G, N303S and N336Q |
| T85L, N130K, E154D, A289P, N303S and N336Q | T85L, N130K, N190D, H225Y, N229E and V258G | T85L, N130K, N190D, H225Y, N229E and A289P | T85L, N130K, N190D, H225Y, N229E and N303S | T85L, N130K, N190D, H225Y, N229E and N336Q |
| T85L, N130K, N190D, H225Y, V258G and A289P | T85L, N130K, N190D, H225Y, V258G and N303S | T85L, N130K, N190D, H225Y, V258G and N336Q | T85L, N130K, N190D, H225Y, A289P and N303S | T85L, N130K, N190D, H225Y, A289P and N336Q |
| T85L, N130K, N190D, H225Y, N303S and N336Q | T85L, N130K, N190D, N229E, V258G and A289P | T85L, N130K, N190D, N229E, V258G and N303S | T85L, N130K, N190D, N229E, V258G and N336Q | T85L, N130K, N190D, N229E, A289P and N303S |
| T85L, N130K, N190D, N229E, A289P and N336Q | T85L, N130K, N190D, N229E, N303S and N336Q | T85L, N130K, N190D, V258G, A289P and N303S | T85L, N130K, N190D, V258G, A289P and N336Q | T85L, N130K, N190D, V258G, N303S and N336Q |
| T85L, N130K, N190D, A289P, N303S and N336Q | T85L, N130K, H225Y, N229E, V258G and A289P | T85L, N130K, H225Y, N229E, V258G and N303S | T85L, N130K, H225Y, N229E, V258G and N336Q | T85L, N130K, H225Y, N229E, A289P and N303S |
| T85L, N130K, H225Y, N229E, A289P and N336Q | T85L, N130K, H225Y, N229E, N303S and N336Q | T85L, N130K, H225Y, V258G, A289P and N303S | T85L, N130K, H225Y, V258G, A289P and N336Q | T85L, N130K, H225Y, V258G, N303S and N336Q |
| T85L, N130K, H225Y, A289P, N303S and N336Q | T85L, N130K, N229E, V258G, A289P and N303S | T85L, N130K, N229E, V258G, A289P and N336Q | T85L, N130K, N229E, V258G, N303S and N336Q | T85L, N130K, N229E, A289P, N303S and N336Q |
| T85L, N130K, V258G, A289P, N303S and N336Q | T85L, M134L, E154D, N190D, H225Y and N229E | T85L, M134L, E154D, N190D, H225Y and V258G | T85L, M134L, E154D, N190D, H225Y and A289P | T85L, M134L, E154D, N190D, H225Y and N303S |
| T85L, M134L, E154D, N190D, H225Y and N336Q | T85L, M134L, E154D, N190D, N229E and V258G | T85L, M134L, E154D, N190D, N229E and A289P | T85L, M134L, E154D, N190D, N229E and N303S | T85L, M134L, E154D, N190D, N229E and N336Q |
| T85L, M134L, E154D, N190D, V258G and A289P | T85L, M134L, E154D, N190D, V258G and N303S | T85L, M134L, E154D, N190D, V258G and N336Q | T85L, M134L, E154D, N190D, A289P and N303S | T85L, M134L, E154D, N190D, A289P and N336Q |

TABLE 21-continued

Non-limiting examples of mutations [as compared to SEQ ID NO: 35]

| | | | | |
|---|---|---|---|---|
| T85L, M134L, E154D, N190D, N303S and N336Q | T85L, M134L, E154D, H225Y, N229E and V258G | T85L, M134L, E154D, H225Y, N229E and A289P | T85L, M134L, E154D, H225Y, N229E and N303S | T85L, M134L, E154D, H225Y, N229E and N336Q |
| T85L, M134L, E154D, H225Y, V258G and A289P | T85L, M134L, E154D, H225Y, V258G and N303S | T85L, M134L, E154D, H225Y, V258G and N336Q | T85L, M134L, E154D, H225Y, A289P and N303S | T85L, M134L, E154D, H225Y, A289P and N336Q |
| T85L, M134L, E154D, H225Y, N303S and N336Q | T85L, M134L, E154D, N229E, V258G and A289P | T85L, M134L, E154D, N229E, V258G and N303S | T85L, M134L, E154D, N229E, V258G and N336Q | T85L, M134L, E154D, N229E, A289P and N303S |
| T85L, M134L, E154D, N229E, A289P and N336Q | T85L, M134L, E154D, N229E, N303S and N336Q | T85L, M134L, E154D, V258G, A289P and N303S | T85L, M134L, E154D, V258G, A289P and N336Q | T85L, M134L, E154D, V258G, N303S and N336Q |
| T85L, M134L, E154D, A289P, N303S and N336Q | T85L, M134L, N190D, H225Y, N229E and V258G | T85L, M134L, N190D, H225Y, N229E and A289P | T85L, M134L, N190D, H225Y, N229E and N303S | T85L, M134L, N190D, H225Y, N229E and N336Q |
| T85L, M134L, N190D, H225Y, V258G and A289P | T85L, M134L, N190D, H225Y, V258G and N303S | T85L, M134L, N190D, H225Y, V258G and N336Q | T85L, M134L, N190D, H225Y, A289P and N303S | T85L, M134L, N190D, H225Y, A289P and N336Q |
| T85L, M134L, N190D, H225Y, N303S and N336Q | T85L, M134L, N190D, N229E, V258G and A289P | T85L, M134L, N190D, N229E, V258G and N303S | T85L, M134L, N190D, N229E, V258G and N336Q | T85L, M134L, N190D, N229E, A289P and N303S |
| T85L, M134L, N190D, N229E, A289P and N336Q | T85L, M134L, N190D, N229E, N303S and N336Q | T85L, M134L, N190D, V258G, A289P and N303S | T85L, M134L, N190D, V258G, A289P and N336Q | T85L, M134L, N190D, V258G, N303S and N336Q |
| T85L, M134L, N190D, A289P, N303S and N336Q | T85L, M134L, H225Y, N229E, V258G and A289P | T85L, M134L, H225Y, N229E, V258G and N303S | T85L, M134L, H225Y, N229E, V258G and N336Q | T85L, M134L, H225Y, N229E, A289P and N303S |
| T85L, M134L, H225Y, N229E, A289P and N336Q | T85L, M134L, H225Y, N229E, N303S and N336Q | T85L, M134L, H225Y, V258G, A289P and N303S | T85L, M134L, H225Y, V258G, A289P and N336Q | T85L, M134L, H225Y, V258G, N303S and N336Q |
| T85L, M134L, H225Y, A289P, N303S and N336Q | T85L, M134L, N229E, V258G, A289P and N303S | T85L, M134L, N229E, V258G, A289P and N336Q | T85L, M134L, N229E, V258G, N303S and N336Q | T85L, M134L, N229E, A289P, N303S and N336Q |
| T85L, M134L, V258G, A289P, N303S and N336Q | T85L, E154D, N190D, H225Y, N229E and V258G | T85L, E154D, N190D, H225Y, N229E and A289P | T85L, E154D, N190D, H225Y, N229E and N303S | T85L, E154D, N190D, H225Y, N229E and N336Q |
| T85L, E154D, N190D, H225Y, V258G and A289P | T85L, E154D, N190D, H225Y, V258G and N303S | T85L, E154D, N190D, H225Y, V258G and N336Q | T85L, E154D, N190D, H225Y, A289P and N303S | T85L, E154D, N190D, H225Y, A289P and N336Q |
| T85L, E154D, N190D, H225Y, N303S and N336Q | T85L, E154D, N190D, N229E, V258G and A289P | T85L, E154D, N190D, N229E, V258G and N303S | T85L, E154D, N190D, N229E, V258G and N336Q | T85L, E154D, N190D, N229E, A289P and N303S |
| T85L, E154D, N190D, N229E, A289P and N336Q | T85L, E154D, N190D, N229E, N303S and N336Q | T85L, E154D, N190D, V258G, A289P and N303S | T85L, E154D, N190D, V258G, A289P and N336Q | T85L, E154D, N190D, V258G, N303S and N336Q |
| T85L, E154D, N190D, A289P, N303S and N336Q | T85L, E154D, H225Y, N229E, V258G and A289P | T85L, E154D, H225Y, N229E, V258G and N303S | T85L, E154D, H225Y, N229E, V258G and N336Q | T85L, E154D, H225Y, N229E, A289P and N303S |
| T85L, E154D, H225Y, N229E, A289P and N336Q | T85L, E154D, H225Y, N229E, N303S and N336Q | T85L, E154D, H225Y, V258G, A289P and N303S | T85L, E154D, H225Y, V258G, A289P and N336Q | T85L, E154D, H225Y, V258G, N303S and N336Q |
| T85L, E154D, H225Y, A289P, N303S and N336Q | T85L, E154D, N229E, V258G, A289P and N303S | T85L, E154D, N229E, V258G, A289P and N336Q | T85L, E154D, N229E, V258G, N303S and N336Q | T85L, E154D, N229E, A289P, N303S and N336Q |
| T85L, E154D, V258G, A289P, N303S and N336Q | T85L, N190D, H225Y, N229E, V258G and A289P | T85L, N190D, H225Y, N229E, V258G and N303S | T85L, N190D, H225Y, N229E, V258G and N336Q | T85L, N190D, H225Y, N229E, A289P and N303S |
| T85L, N190D, H225Y, N229E, A289P and N336Q | T85L, N190D, H225Y, N229E, N303S and N336Q | T85L, N190D, H225Y, V258G, A289P and N303S | T85L, N190D, H225Y, V258G, A289P and N336Q | T85L, N190D, H225Y, V258G, N303S and N336Q |
| T85L, N190D, H225Y, A289P, N303S and N336Q | T85L, N190D, N229E, V258G, A289P and N303S | T85L, N190D, N229E, V258G, A289P and N336Q | T85L, N190D, N229E, V258G, N303S and N336Q | T85L, N190D, N229E, A289P, N303S and N336Q |
| T85L, N190D, V258G, A289P, N303S and N336Q | T85L, H225Y, N229E, V258G, A289P and N303S | T85L, H225Y, N229E, V258G, A289P and N336Q | T85L, H225Y, N229E, V258G, N303S and N336Q | T85L, H225Y, N229E, A289P, N303S and N336Q |
| T85L, H225Y, V258G, A289P, N303S and N336Q | T85L, N229E, V258G, A289P, N303S and N336Q | H121Y, N130K, M134L, E154D, N190D and H225Y | H121Y, N130K, M134L, E154D, N190D and N229E | H121Y, N130K, M134L, E154D, N190D and V258G |
| H121Y, N130K, M134L, E154D, N190D and A289P | H121Y, N130K, M134L, E154D, N190D and N303S | H121Y, N130K, M134L, E154D, N190D and N336Q | H121Y, N130K, M134L, E154D, H225Y and N229E | H121Y, N130K, M134L, E154D, H225Y and V258G |
| H121Y, N130K, M134L, E154D, H225Y and A289P | H121Y, N130K, M134L, E154D, H225Y and N303S | H121Y, N130K, M134L, E154D, H225Y and N336Q | H121Y, N130K, M134L, E154D, N229E and V258G | H121Y, N130K, M134L, E154D, N229E and A289P |
| H121Y, N130K, M134L, E154D, N229E and N303S | H121Y, N130K, M134L, E154D, N229E and N336Q | H121Y, N130K, M134L, E154D, V258G and A289P | H121Y, N130K, M134L, E154D, V258G and N303S | H121Y, N130K, M134L, E154D, V258G and N336Q |

TABLE 21-continued

| Non-limiting examples of mutations [as compared to SEQ ID NO: 35] | | | | |
|---|---|---|---|---|
| H121Y, N130K, M134L, E154D, A289P and N303S | H121Y, N130K, M134L, E154D, A289P and N336Q | H121Y, N130K, M134L, E154D, N303S and N336Q | H121Y, N130K, M134L, N190D, H225Y and N229E | H121Y, N130K, M134L, N190D, H225Y and V258G |
| H121Y, N130K, M134L, N190D, H225Y and A289P | H121Y, N130K, M134L, N190D, H225Y and N303S | H121Y, N130K, M134L, N190D, H225Y and N336Q | H121Y, N130K, M134L, N190D, N229E and V258G | H121Y, N130K, M134L, N190D, N229E and A289P |
| H121Y, N130K, M134L, N190D, N229E and N303S | H121Y, N130K, M134L, N190D, N229E and N336Q | H121Y, N130K, M134L, N190D, V258G and A289P | H121Y, N130K, M134L, N190D, V258G and N303S | H121Y, N130K, M134L, N190D, V258G and N336Q |
| H121Y, N130K, M134L, N190D, A289P and N303S | H121Y, N130K, M134L, N190D, A289P and N336Q | H121Y, N130K, M134L, N190D, N303S and N336Q | H121Y, N130K, M134L, H225Y, N229E and V258G | H121Y, N130K, M134L, H225Y, N229E and A289P |
| H121Y, N130K, M134L, H225Y, N229E and N303S | H121Y, N130K, M134L, H225Y, N229E and N336Q | H121Y, N130K, M134L, H225Y, V258G and A289P | H121Y, N130K, M134L, H225Y, V258G and N303S | H121Y, N130K, M134L, H225Y, V258G and N336Q |
| H121Y, N130K, M134L, H225Y, A289P and N303S | H121Y, N130K, M134L, H225Y, A289P and N336Q | H121Y, N130K, M134L, H225Y, N303S and N336Q | H121Y, N130K, M134L, N229E, V258G and A289P | H121Y, N130K, M134L, N229E, V258G and N303S |
| H121Y, N130K, M134L, N229E, V258G and N336Q | H121Y, N130K, M134L, N229E, A289P and N303S | H121Y, N130K, M134L, N229E, A289P and N336Q | H121Y, N130K, M134L, N229E, N303S and N336Q | H121Y, N130K, M134L, V258G, A289P and N303S |
| H121Y, N130K, M134L, V258G, A289P and N336Q | H121Y, N130K, M134L, V258G, N303S and N336Q | H121Y, N130K, M134L, A289P, N303S and N336Q | H121Y, N130K, E154D, N190D, H225Y and N229E | H121Y, N130K, E154D, N190D, H225Y and V258G |
| H121Y, N130K, E154D, N190D, H225Y and A289P | H121Y, N130K, E154D, N190D, H225Y and N303S | H121Y, N130K, E154D, N190D, H225Y and N336Q | H121Y, N130K, E154D, N190D, N229E and V258G | H121Y, N130K, E154D, N190D, N229E and A289P |
| H121Y, N130K, E154D, N190D, N229E and N303S | H121Y, N130K, E154D, N190D, N229E and N336Q | H121Y, N130K, E154D, N190D, V258G and A289P | H121Y, N130K, E154D, N190D, V258G and N303S | H121Y, N130K, E154D, N190D, V258G and N336Q |
| H121Y, N130K, E154D, N190D, A289P and N303S | H121Y, N130K, E154D, N190D, A289P and N336Q | H121Y, N130K, E154D, N190D, N303S and N336Q | H121Y, N130K, E154D, H225Y, N229E and V258G | H121Y, N130K, E154D, H225Y, N229E and A289P |
| H121Y, N130K, E154D, H225Y, N229E and N303S | H121Y, N130K, E154D, H225Y, N229E and N336Q | H121Y, N130K, E154D, H225Y, V258G and A289P | H121Y, N130K, E154D, H225Y, V258G and N303S | H121Y, N130K, E154D, H225Y, V258G and N336Q |
| H121Y, N130K, E154D, H225Y, A289P and N303S | H121Y, N130K, E154D, H225Y, A289P and N336Q | H121Y, N130K, E154D, H225Y, N303S and N336Q | H121Y, N130K, E154D, N229E, V258G and A289P | H121Y, N130K, E154D, N229E, V258G and N303S |
| H121Y, N130K, E154D, N229E, V258G and N336Q | H121Y, N130K, E154D, N229E, A289P and N303S | H121Y, N130K, E154D, N229E, A289P and N336Q | H121Y, N130K, E154D, N229E, N303S and N336Q | H121Y, N130K, E154D, V258G, A289P and N303S |
| H121Y, N130K, E154D, V258G, A289P and N336Q | H121Y, N130K, E154D, V258G, N303S and N336Q | H121Y, N130K, E154D, A289P, N303S and N336Q | H121Y, N130K, N190D, H225Y, N229E and V258G | H121Y, N130K, N190D, H225Y, N229E and A289P |
| H121Y, N130K, N190D, H225Y, N229E and N303S | H121Y, N130K, N190D, H225Y, N229E and N336Q | H121Y, N130K, N190D, H225Y, V258G and A289P | H121Y, N130K, N190D, H225Y, V258G and N303S | H121Y, N130K, N190D, H225Y, V258G and N336Q |
| H121Y, N130K, N190D, H225Y, A289P and N303S | H121Y, N130K, N190D, H225Y, A289P and N336Q | H121Y, N130K, N190D, H225Y, N303S and N336Q | H121Y, N130K, N190D, N229E, V258G and A289P | H121Y, N130K, N190D, N229E, V258G and N303S |
| H121Y, N130K, N190D, N229E, V258G and N336Q | H121Y, N130K, N190D, N229E, A289P and N303S | H121Y, N130K, N190D, N229E, A289P and N336Q | H121Y, N130K, N190D, N229E, N303S and N336Q | H121Y, N130K, N190D, V258G, A289P and N303S |
| H121Y, N130K, N190D, V258G, A289P and N336Q | H121Y, N130K, N190D, V258G, N303S and N336Q | H121Y, N130K, N190D, A289P, N303S and N336Q | H121Y, N130K, H225Y, N229E, V258G and A289P | H121Y, N130K, H225Y, N229E, V258G and N303S |
| H121Y, N130K, H225Y, N229E, V258G and N336Q | H121Y, N130K, H225Y, N229E, A289P and N303S | H121Y, N130K, H225Y, N229E, A289P and N336Q | H121Y, N130K, H225Y, N229E, N303S and N336Q | H121Y, N130K, H225Y, V258G, A289P and N303S |
| H121Y, N130K, H225Y, V258G, A289P and N336Q | H121Y, N130K, H225Y, V258G, N303S and N336Q | H121Y, N130K, H225Y, A289P, N303S and N336Q | H121Y, N130K, N229E, V258G, A289P and N303S | H121Y, N130K, N229E, V258G, A289P and N336Q |
| H121Y, N130K, N229E, V258G, N303S and N336Q | H121Y, N130K, N229E, A289P, N303S and N336Q | H121Y, N130K, V258G, A289P, N303S and N336Q | H121Y, M134L, E154D, N190D, H225Y and N229E | H121Y, M134L, E154D, N190D, H225Y and V258G |
| H121Y, M134L, E154D, N190D, H225Y and A289P | H121Y, M134L, E154D, N190D, H225Y and N303S | H121Y, M134L, E154D, N190D, H225Y and N336Q | H121Y, M134L, E154D, N190D, N229E and V258G | H121Y, M134L, E154D, N190D, N229E and A289P |
| H121Y, M134L, E154D, N190D, N229E and N303S | H121Y, M134L, E154D, N190D, N229E and N336Q | H121Y, M134L, E154D, N190D, V258G and A289P | H121Y, M134L, E154D, N190D, V258G and N303S | H121Y, M134L, E154D, N190D, V258G and N336Q |
| H121Y, M134L, E154D, N190D, A289P and N303S | H121Y, M134L, E154D, N190D, A289P and N336Q | H121Y, M134L, E154D, N190D, N303S and N336Q | H121Y, M134L, E154D, H225Y, N229E and V258G | H121Y, M134L, E154D, H225Y, N229E and A289P |
| H121Y, M134L, E154D, H225Y, N229E and N303S | H121Y, M134L, E154D, H225Y, N229E and N336Q | H121Y, M134L, E154D, H225Y, V258G and A289P | H121Y, M134L, E154D, H225Y, V258G and N303S | H121Y, M134L, E154D, H225Y, V258G and N336Q |

TABLE 21-continued

Non-limiting examples of mutations [as compared to SEQ ID NO: 35]

| | | | | |
|---|---|---|---|---|
| H121Y, M134L, E154D, H225Y, A289P and N303S | H121Y, M134L, E154D, H225Y, A289P and N336Q | H121Y, M134L, E154D, H225Y, N303S and N336Q | H121Y, M134L, E154D, N229E, V258G and A289P | H121Y, M134L, E154D, N229E, V258G and N303S |
| H121Y, M134L, E154D, N229E, V258G and N336Q | H121Y, M134L, E154D, N229E, A289P and N303S | H121Y, M134L, E154D, N229E, A289P and N336Q | H121Y, M134L, E154D, N229E, N303S and N336Q | H121Y, M134L, E154D, V258G, A289P and N303S |
| H121Y, M134L, E154D, V258G, A289P and N336Q | H121Y, M134L, E154D, V258G, N303S and N336Q | H121Y, M134L, E154D, A289P, N303S and N336Q | H121Y, M134L, N190D, H225Y, N229E and V258G | H121Y, M134L, N190D, H225Y, N229E and A289P |
| H121Y, M134L, N190D, H225Y, N229E and N303S | H121Y, M134L, N190D, H225Y, N229E and N336Q | H121Y, M134L, N190D, H225Y, V258G and A289P | H121Y, M134L, N190D, H225Y, V258G and N303S | H121Y, M134L, N190D, H225Y, V258G and N336Q |
| H121Y, M134L, N190D, H225Y, A289P and N303S | H121Y, M134L, N190D, H225Y, A289P and N336Q | H121Y, M134L, N190D, H225Y, N303S and N336Q | H121Y, M134L, N190D, N229E, V258G and A289P | H121Y, M134L, N190D, N229E, V258G and N303S |
| H121Y, M134L, N190D, N229E, V258G and N336Q | H121Y, M134L, N190D, N229E, A289P and N303S | H121Y, M134L, N190D, N229E, A289P and N336Q | H121Y, M134L, N190D, N229E, N303S and N336Q | H121Y, M134L, N190D, V258G, A289P and N303S |
| H121Y, M134L, N190D, V258G, A289P and N336Q | H121Y, M134L, N190D, V258G, N303S and N336Q | H121Y, M134L, N190D, A289P, N303S and N336Q | H121Y, M134L, H225Y, N229E, V258G and A289P | H121Y, M134L, H225Y, N229E, V258G and N303S |
| H121Y, M134L, H225Y, N229E, V258G and N336Q | H121Y, M134L, H225Y, N229E, A289P and N303S | H121Y, M134L, H225Y, N229E, A289P and N336Q | H121Y, M134L, H225Y, N229E, N303S and N336Q | H121Y, M134L, H225Y, V258G, A289P and N303S |
| H121Y, M134L, H225Y, V258G, A289P and N336Q | H121Y, M134L, H225Y, V258G, N303S and N336Q | H121Y, M134L, H225Y, A289P, N303S and N336Q | H121Y, M134L, N229E, V258G, A289P and N303S | H121Y, M134L, N229E, V258G, A289P and N336Q |
| H121Y, M134L, N229E, V258G, N303S and N336Q | H121Y, M134L, N229E, A289P, N303S and N336Q | H121Y, M134L, V258G, A289P, N303S and N336Q | H121Y, E154D, N190D, H225Y, N229E and V258G | H121Y, E154D, N190D, H225Y, N229E and A289P |
| H121Y, E154D, N190D, H225Y, N229E and N303S | H121Y, E154D, N190D, H225Y, N229E and N336Q | H121Y, E154D, N190D, H225Y, V258G and A289P | H121Y, E154D, N190D, H225Y, V258G and N303S | H121Y, E154D, N190D, H225Y, V258G and N336Q |
| H121Y, E154D, N190D, H225Y, A289P and N303S | H121Y, E154D, N190D, H225Y, A289P and N336Q | H121Y, E154D, N190D, H225Y, N303S and N336Q | H121Y, E154D, N190D, N229E, V258G and A289P | H121Y, E154D, N190D, N229E, V258G and N303S |
| H121Y, E154D, N190D, N229E, V258G and N336Q | H121Y, E154D, N190D, N229E, A289P and N303S | H121Y, E154D, N190D, N229E, A289P and N336Q | H121Y, E154D, N190D, N229E, N303S and N336Q | H121Y, E154D, N190D, V258G, A289P and N303S |
| H121Y, E154D, N190D, V258G, A289P and N336Q | H121Y, E154D, N190D, V258G, N303S and N336Q | H121Y, E154D, N190D, A289P, N303S and N336Q | H121Y, E154D, H225Y, N229E, V258G and A289P | H121Y, E154D, H225Y, N229E, V258G and N303S |
| H121Y, E154D, H225Y, N229E, V258G and N336Q | H121Y, E154D, H225Y, N229E, A289P and N303S | H121Y, E154D, H225Y, N229E, A289P and N336Q | H121Y, E154D, H225Y, N229E, N303S and N336Q | H121Y, E154D, H225Y, V258G, A289P and N303S |
| H121Y, E154D, H225Y, V258G, A289P and N336Q | H121Y, E154D, H225Y, V258G, N303S and N336Q | H121Y, E154D, H225Y, A289P, N303S and N336Q | H121Y, E154D, N229E, V258G, A289P and N303S | H121Y, E154D, N229E, V258G, A289P and N336Q |
| H121Y, E154D, N229E, V258G, N303S and N336Q | H121Y, E154D, N229E, A289P, N303S and N336Q | H121Y, E154D, V258G, A289P, N303S and N336Q | H121Y, N190D, H225Y, N229E, V258G and A289P | H121Y, N190D, H225Y, N229E, V258G and N303S |
| H121Y, N190D, H225Y, N229E, V258G and N336Q | H121Y, N190D, H225Y, N229E, A289P and N303S | H121Y, N190D, H225Y, N229E, A289P and N336Q | H121Y, N190D, H225Y, N229E, N303S and N336Q | H121Y, N190D, H225Y, V258G, A289P and N303S |
| H121Y, N190D, H225Y, V258G, A289P and N336Q | H121Y, N190D, H225Y, V258G, N303S and N336Q | H121Y, N190D, H225Y, A289P, N303S and N336Q | H121Y, N190D, N229E, V258G, A289P and N303S | H121Y, N190D, N229E, V258G, A289P and N336Q |
| H121Y, N190D, N229E, V258G, N303S and N336Q | H121Y, N190D, N229E, A289P, N303S and N336Q | H121Y, N190D, V258G, A289P, N303S and N336Q | H121Y, H225Y, N229E, V258G, A289P and N303S | H121Y, H225Y, N229E, V258G, A289P and N336Q |
| H121Y, H225Y, N229E, V258G, N303S and N336Q | H121Y, H225Y, N229E, A289P, N303S and N336Q | H121Y, H225Y, V258G, A289P, N303S and N336Q | H121Y, N229E, V258G, A289P, N303S and N336Q | N130K, M134L, E154D, N190D, H225Y and N229E |
| N130K, M134L, E154D, N190D, H225Y and V258G | N130K, M134L, E154D, N190D, H225Y and A289P | N130K, M134L, E154D, N190D, H225Y and N303S | N130K, M134L, E154D, N190D, H225Y and N336Q | N130K, M134L, E154D, N190D, N229E and V258G |
| N130K, M134L, E154D, N190D, N229E and A289P | N130K, M134L, E154D, N190D, N229E and N303S | N130K, M134L, E154D, N190D, N229E and N336Q | N130K, M134L, E154D, N190D, V258G and A289P | N130K, M134L, E154D, N190D, V258G and N303S |
| N130K, M134L, E154D, N190D, V258G and N336Q | N130K, M134L, E154D, N190D, A289P and N303S | N130K, M134L, E154D, N190D, A289P and N336Q | N130K, M134L, E154D, N190D, N303S and N336Q | N130K, M134L, E154D, H225Y, N229E and V258G |
| N130K, M134L, E154D, H225Y, N229E and A289P | N130K, M134L, E154D, H225Y, N229E and N303S | N130K, M134L, E154D, H225Y, N229E and N336Q | N130K, M134L, E154D, H225Y, V258G and A289P | N130K, M134L, E154D, H225Y, V258G and N303S |
| N130K, M134L, E154D, H225Y, V258G and N336Q | N130K, M134L, E154D, H225Y, A289P and N303S | N130K, M134L, E154D, H225Y, A289P and N336Q | N130K, M134L, E154D, H225Y, N303S and N336Q | N130K, M134L, E154D, N229E, V258G and A289P |

TABLE 21-continued

| Non-limiting examples of mutations [as compared to SEQ ID NO: 35] | | | | |
|---|---|---|---|---|
| N130K, M134L, E154D, N229E, V258G and N303S | N130K, M134L, E154D, N229E, V258G and N336Q | N130K, M134L, E154D, N229E, A289P and N303S | N130K, M134L, E154D, N229E, A289P and N336Q | N130K, M134L, E154D, N229E, N303S and N336Q |
| N130K, M134L, E154D, V258G, A289P and N303S | N130K, M134L, E154D, V258G, A289P and N336Q | N130K, M134L, E154D, V258G, N303S and N336Q | N130K, M134L, E154D, A289P, N303S and N336Q | N130K, M134L, N190D, H225Y, N229E and V258G |
| N130K, M134L, N190D, H225Y, N229E and A289P | N130K, M134L, N190D, H225Y, N229E and N303S | N130K, M134L, N190D, H225Y, N229E and N336Q | N130K, M134L, N190D, H225Y, V258G and A289P | N130K, M134L, N190D, H225Y, V258G and N303S |
| N130K, M134L, N190D, H225Y, V258G and N336Q | N130K, M134L, N190D, H225Y, A289P and N303S | N130K, M134L, N190D, H225Y, A289P and N336Q | N130K, M134L, N190D, H225Y, N303S and N336Q | N130K, M134L, N190D, N229E, V258G and A289P |
| N130K, M134L, N190D, N229E, V258G and N303S | N130K, M134L, N190D, N229E, V258G and N336Q | N130K, M134L, N190D, N229E, A289P and N303S | N130K, M134L, N190D, N229E, A289P and N336Q | N130K, M134L, N190D, N229E, N303S and N336Q |
| N130K, M134L, N190D, V258G, A289P and N303S | N130K, M134L, N190D, V258G, A289P and N336Q | N130K, M134L, N190D, V258G, N303S and N336Q | N130K, M134L, N190D, A289P, N303S and N336Q | N130K, M134L, H225Y, N229E, V258G and A289P |
| N130K, M134L, H225Y, N229E, V258G and N303S | N130K, M134L, H225Y, N229E, V258G and N336Q | N130K, M134L, H225Y, N229E, A289P and N303S | N130K, M134L, H225Y, N229E, A289P and N336Q | N130K, M134L, H225Y, N229E, N303S and N336Q |
| N130K, M134L, H225Y, V258G, A289P and N303S | N130K, M134L, H225Y, V258G, A289P and N336Q | N130K, M134L, H225Y, V258G, N303S and N336Q | N130K, M134L, H225Y, A289P, N303S and N336Q | N130K, M134L, N229E, V258G, A289P and N303S |
| N130K, M134L, N229E, V258G, A289P and N336Q | N130K, M134L, N229E, V258G, N303S and N336Q | N130K, M134L, N229E, A289P, N303S and N336Q | N130K, M134L, V258G, A289P, N303S and N336Q | N130K, E154D, N190D, H225Y, N229E and V258G |
| N130K, E154D, N190D, H225Y, N229E and A289P | N130K, E154D, N190D, H225Y, N229E and N303S | N130K, E154D, N190D, H225Y, N229E and N336Q | N130K, E154D, N190D, H225Y, V258G and A289P | N130K, E154D, N190D, H225Y, V258G and N303S |
| N130K, E154D, N190D, H225Y, V258G and N336Q | N130K, E154D, N190D, H225Y, A289P and N303S | N130K, E154D, N190D, H225Y, A289P and N336Q | N130K, E154D, N190D, H225Y, N303S and N336Q | N130K, E154D, N190D, N229E, V258G and A289P |
| N130K, E154D, N190D, N229E, V258G and N303S | N130K, E154D, N190D, N229E, V258G and N336Q | N130K, E154D, N190D, N229E, A289P and N303S | N130K, E154D, N190D, N229E, A289P and N336Q | N130K, E154D, N190D, N229E, N303S and N336Q |
| N130K, E154D, N190D, V258G, A289P and N303S | N130K, E154D, N190D, V258G, A289P and N336Q | N130K, E154D, N190D, V258G, N303S and N336Q | N130K, E154D, N190D, A289P, N303S and N336Q | N130K, E154D, H225Y, N229E, V258G and A289P |
| N130K, E154D, H225Y, N229E, V258G and N303S | N130K, E154D, H225Y, N229E, V258G and N336Q | N130K, E154D, H225Y, N229E, A289P and N303S | N130K, E154D, H225Y, N229E, A289P and N336Q | N130K, E154D, H225Y, N229E, N303S and N336Q |
| N130K, E154D, H225Y, V258G, A289P and N303S | N130K, E154D, H225Y, V258G, A289P and N336Q | N130K, E154D, H225Y, V258G, N303S and N336Q | N130K, E154D, H225Y, A289P, N303S and N336Q | N130K, E154D, N229E, V258G, A289P and N303S |
| N130K, E154D, N229E, V258G, A289P and N336Q | N130K, E154D, N229E, V258G, N303S and N336Q | N130K, E154D, N229E, A289P, N303S and N336Q | N130K, E154D, V258G, A289P, N303S and N336Q | N130K, N190D, H225Y, N229E, V258G and A289P |
| N130K, N190D, H225Y, N229E, V258G and N303S | N130K, N190D, H225Y, N229E, V258G and N336Q | N130K, N190D, H225Y, N229E, A289P and N303S | N130K, N190D, H225Y, N229E, A289P and N336Q | N130K, N190D, H225Y, N229E, N303S and N336Q |
| N130K, N190D, H225Y, V258G, A289P and N303S | N130K, N190D, H225Y, V258G, A289P and N336Q | N130K, N190D, H225Y, V258G, N303S and N336Q | N130K, N190D, H225Y, A289P, N303S and N336Q | N130K, N190D, N229E, V258G, A289P and N303S |
| N130K, N190D, N229E, V258G, A289P and N336Q | N130K, N190D, N229E, V258G, N303S and N336Q | N130K, N190D, N229E, A289P, N303S and N336Q | N130K, N190D, V258G, A289P, N303S and N336Q | N130K, H225Y, N229E, V258G, A289P and N303S |
| N130K, H225Y, N229E, V258G, A289P and N336Q | N130K, H225Y, N229E, V258G, N303S and N336Q | N130K, H225Y, N229E, A289P, N303S and N336Q | N130K, H225Y, V258G, A289P, N303S and N336Q | N130K, N229E, V258G, A289P, N303S and N336Q |
| M134L, E154D, N190D, H225Y, N229E and V258G | M134L, E154D, N190D, H225Y, N229E and A289P | M134L, E154D, N190D, H225Y, N229E and N303S | M134L, E154D, N190D, H225Y, N229E and N336Q | M134L, E154D, N190D, H225Y, V258G and A289P |
| M134L, E154D, N190D, H225Y, V258G and N303S | M134L, E154D, N190D, H225Y, V258G and N336Q | M134L, E154D, N190D, H225Y, A289P and N303S | M134L, E154D, N190D, H225Y, A289P and N336Q | M134L, E154D, N190D, H225Y, N303S and N336Q |
| M134L, E154D, N190D, N229E, V258G and A289P | M134L, E154D, N190D, N229E, V258G and N303S | M134L, E154D, N190D, N229E, V258G and N336Q | M134L, E154D, N190D, N229E, A289P and N303S | M134L, E154D, N190D, N229E, A289P and N336Q |
| M134L, E154D, N190D, N229E, N303S and N336Q | M134L, E154D, N190D, V258G, A289P and N303S | M134L, E154D, N190D, V258G, A289P and N336Q | M134L, E154D, N190D, V258G, N303S and N336Q | M134L, E154D, N190D, A289P, N303S and N336Q |
| M134L, E154D, H225Y, N229E, V258G and A289P | M134L, E154D, H225Y, N229E, V258G and N303S | M134L, E154D, H225Y, N229E, V258G and N336Q | M134L, E154D, H225Y, N229E, A289P and N303S | M134L, E154D, H225Y, N229E, A289P and N336Q |
| M134L, E154D, H225Y, N229E, N303S and N336Q | M134L, E154D, H225Y, V258G, A289P and N303S | M134L, E154D, H225Y, V258G, A289P and N336Q | M134L, E154D, H225Y, V258G, N303S and N336Q | M134L, E154D, H225Y, A289P, N303S and N336Q |

TABLE 21-continued

Non-limiting examples of mutations [as compared to SEQ ID NO: 35]

| | | | | |
|---|---|---|---|---|
| M134L, E154D, N229E, V258G, A289P and N303S | M134L, E154D, N229E, V258G, A289P and N336Q | M134L, E154D, N229E, V258G, N303S and N336Q | M134L, E154D, N229E, A289P, N303S and N336Q | M134L, E154D, V258G, A289P, N303S and N336Q |
| M134L, N190D, H225Y, N229E, V258G and A289P | M134L, N190D, H225Y, N229E, V258G and N303S | M134L, N190D, H225Y, N229E, V258G and N336Q | M134L, N190D, H225Y, N229E, A289P and N303S | M134L, N190D, H225Y, N229E, A289P and N336Q |
| M134L, N190D, H225Y, N229E, N303S and N336Q | M134L, N190D, H225Y, V258G, A289P and N303S | M134L, N190D, H225Y, V258G, A289P and N336Q | M134L, N190D, H225Y, V258G, N303S and N336Q | M134L, N190D, H225Y, A289P, N303S and N336Q |
| M134L, N190D, N229E, V258G, A289P and N303S | M134L, N190D, N229E, V258G, A289P and N336Q | M134L, N190D, N229E, V258G, N303S and N336Q | M134L, N190D, N229E, A289P, N303S and N336Q | M134L, N190D, V258G, A289P, N303S and N336Q |
| M134L, H225Y, N229E, V258G, A289P and N303S | M134L, H225Y, N229E, V258G, A289P and N336Q | M134L, H225Y, N229E, V258G, N303S and N336Q | M134L, H225Y, N229E, A289P, N303S and N336Q | M134L, H225Y, V258G, A289P, N303S and N336Q |
| M134L, N229E, V258G, A289P, N303S and N336Q | E154D, N190D, H225Y, N229E, V258G and A289P | E154D, N190D, H225Y, N229E, V258G and N303S | E154D, N190D, H225Y, N229E, V258G and N336Q | E154D, N190D, H225Y, N229E, A289P and N303S |
| E154D, N190D, H225Y, N229E, A289P and N336Q | E154D, N190D, H225Y, N229E, N303S and N336Q | E154D, N190D, H225Y, V258G, A289P and N303S | E154D, N190D, H225Y, V258G, A289P and N336Q | E154D, N190D, H225Y, V258G, N303S and N336Q |
| E154D, N190D, H225Y, A289P, N303S and N336Q | E154D, N190D, N229E, V258G, A289P and N303S | E154D, N190D, N229E, V258G, A289P and N336Q | E154D, N190D, N229E, V258G, N303S and N336Q | E154D, N190D, N229E, A289P, N303S and N336Q |
| E154D, N190D, V258G, A289P, N303S and N336Q | E154D, H225Y, N229E, V258G, A289P and N303S | E154D, H225Y, N229E, V258G, A289P and N336Q | E154D, H225Y, N229E, V258G, N303S and N336Q | E154D, H225Y, N229E, A289P, N303S and N336Q |
| E154D, H225Y, V258G, A289P, N303S and N336Q | E154D, N229E, V258G, A289P, N303S and N336Q | N190D, H225Y, N229E, V258G, A289P and N303S | N190D, H225Y, N229E, V258G, A289P and N336Q | N190D, H225Y, N229E, V258G, N303S and N336Q |
| N190D, H225Y, N229E, A289P, N303S and N336Q | N190D, H225Y, V258G, A289P, N303S and N336Q | N190D, N229E, V258G, A289P, N303S and N336Q | H225Y, N229E, V258G, A289P, N303S and N336Q | A60T, N61D, T63I, Q64K, V74K and N76G |
| A60T, N61D, T63I, Q64K, V74K and H146S | A60T, N61D, T63I, Q64K, V74K and F227L | A60T, N61D, T63I, Q64K, V74K and E229N | A60T, N61D, T63I, Q64K, N76G and H146S | A60T, N61D, T63I, Q64K, N76G and F227L |
| A60T, N61D, T63I, Q64K, N76G and E229N | A60T, N61D, T63I, Q64K, H146S and F227L | A60T, N61D, T63I, Q64K, H146S and E229N | A60T, N61D, T63I, Q64K, F227L and E229N | A60T, N61D, T63I, V74K, N76G and H146S |
| A60T, N61D, T63I, V74K, N76G and F227L | A60T, N61D, T63I, V74K, N76G and E229N | A60T, N61D, T63I, V74K, H146S and F227L | A60T, N61D, T63I, V74K, H146S and E229N | A60T, N61D, T63I, V74K, F227L and E229N |
| A60T, N61D, T63I, N76G, H146S and F227L | A60T, N61D, T63I, N76G, H146S and E229N | A60T, N61D, T63I, N76G, F227L and E229N | A60T, N61D, T63I, H146S, F227L and E229N | A60T, N61D, Q64K, V74K, N76G and H146S |
| A60T, N61D, Q64K, V74K, N76G and F227L | A60T, N61D, Q64K, V74K, N76G and E229N | A60T, N61D, Q64K, V74K, H146S and F227L | A60T, N61D, Q64K, V74K, H146S and E229N | A60T, N61D, Q64K, V74K, F227L and E229N |
| A60T, N61D, Q64K, N76G, H146S and F227L | A60T, N61D, Q64K, N76G, H146S and E229N | A60T, N61D, Q64K, N76G, F227L and E229N | A60T, N61D, N76G, H146S, F227L and E229N | A60T, N61D, V74K, N76G, H146S and F227L |
| A60T, N61D, V74K, N76G, H146S and E229N | A60T, N61D, V74K, N76G, F227L and E229N | A60T, N61D, V74K, H146S, F227L and E229N | A60T, N61D, N76G, H146S, F227L and E229N | A60T, T63I, Q64K, V74K, N76G and H146S |
| A60T, T63I, Q64K, V74K, N76G and F227L | A60T, T63I, Q64K, V74K, N76G and E229N | A60T, T63I, Q64K, V74K, H146S and F227L | A60T, T63I, Q64K, V74K, H146S and E229N | A60T, T63I, Q64K, V74K, F227L and E229N |
| A60T, T63I, Q64K, N76G, H146S and F227L | A60T, T63I, Q64K, N76G, H146S and E229N | A60T, T63I, Q64K, N76G, F227L and E229N | A60T, T63I, Q64K, H146S, F227L and E229N | A60T, T63I, V74K, N76G, H146S and F227L |
| A60T, T63I, V74K, N76G, H146S and E229N | A60T, T63I, V74K, N76G, F227L and E229N | A60T, T63I, V74K, H146S, F227L and E229N | A60T, T63I, N76G, H146S, F227L and E229N | A60T, Q64K, V74K, N76G, H146S and F227L |
| A60T, Q64K, V74K, N76G, H146S and E229N | A60T, Q64K, V74K, N76G, F227L and E229N | A60T, Q64K, V74K, H146S, F227L and E229N | A60T, Q64K, N76G, H146S, F227L and E229N | A60T, V74K, N76G, H146S, F227L and E229N |
| N61D, T63I, Q64K, V74K, N76G and H146S | N61D, T63I, Q64K, V74K, N76G and F227L | N61D, T63I, Q64K, V74K, N76G and E229N | N61D, T63I, Q64K, V74K, H146S and F227L | N61D, T63I, Q64K, V74K, H146S and E229N |
| N61D, T63I, Q64K, V74K, F227L and E229N | N61D, T63I, Q64K, N76G, H146S and F227L | N61D, T63I, Q64K, N76G, H146S and E229N | N61D, T63I, Q64K, N76G, F227L and E229N | N61D, T63I, Q64K, H146S, F227L and E229N |
| N61D, T63I, V74K, N76G, H146S and F227L | N61D, T63I, V74K, N76G, H146S and E229N | N61D, T63I, V74K, N76G, F227L and E229N | N61D, T63I, V74K, H146S, F227L and E229N | N61D, T63I, N76G, H146S, F227L and E229N |
| N61D, Q64K, V74K, N76G, H146S and F227L | N61D, Q64K, V74K, N76G, H146S and E229N | N61D, Q64K, V74K, N76G, F227L and E229N | N61D, Q64K, V74K, H146S, F227L and E229N | N61D, Q64K, N76G, H146S, F227L and E229N |
| N61D, V74K, N76G, H146S, F227L and E229N | T63I, Q64K, V74K, N76G, H146S and F227L | T63I, Q64K, V74K, N76G, H146S and E229N | T63I, Q64K, V74K, N76G, F227L and E229N | T63I, Q64K, V74K, H146S, F227L and E229N |
| T63I, Q64K, N76G, H146S, F227L and E229N | T63I, V74K, N76G, H146S, F227L and E229N | Q64K, V74K, N76G, H146S, F227L and E229N | | |
| A60T, N61D, T63I, Q64K, V74K, N76G and H146S | A60T, N61D, T63I, Q64K, V74K, N76G and F227L | A60T, N61D, T63I, Q64K, V74K, N76G and E229N | A60T, N61D, T63I, Q64K, V74K, H146S and F227L | A60T, N61D, T63I, Q64K, V74K, H146S and E229N |
| A60T, N61D, T63I, Q64K, V74K, F227L and E229N | A60T, N61D, T63I, Q64K, N76G, H146S and F227L | A60T, N61D, T63I, Q64K, N76G, H146S and E229N | A60T, N61D, T63I, Q64K, N76G, F227L and E229N | A60T, N61D, T63I, Q64K, H146S, F227L and E229N |
| A60T, N61D, T63I, V74K, N76G, H146S and F227L | A60T, N61D, T63I, V74K, N76G, H146S and E229N | A60T, N61D, T63I, V74K, N76G, F227L and E229N | A60T, N61D, T63I, V74K, H146S, F227L and E229N | A60T, N61D, T63I, N76G, H146S, F227L and E229N |

TABLE 21-continued

Non-limiting examples of mutations [as compared to SEQ ID NO: 35]

| | | | | |
|---|---|---|---|---|
| A60T, N61D, Q64K, V74K, N76G, H146S and F227L | A60T, N61D, Q64K, V74K, N76G, H146S and E229N | A60T, N61D, Q64K, V74K, N76G, F227L and E229N | A60T, N61D, Q64K, V74K, H146S, F227L and E229N | A60T, N61D, Q64K, N76G, H146S, F227L and E229N |
| A60T, N61D, V74K, N76G, H146S, F227L and E229N | A60T, T63I, Q64K, V74K, N76G, H146S and F227L | A60T, T63I, Q64K, V74K, N76G, H146S and E229N | A60T, T63I, Q64K, V74K, N76G, F227L and E229N | A60T, T63I, Q64K, V74K, H146S, F227L and E229N |
| A60T, T63I, Q64K, N76G, H146S, F227L and E229N | A60T, T63I, V74K, N76G, H146S, F227L and E229N | A60T, Q64K, V74K, N76G, H146S, F227L and E229N | N61D, T63I, Q64K, V74K, N76G, H146S and F227L | N61D, T63I, Q64K, V74K, N76G, H146S and E229N |
| N61D, T63I, Q64K, V74K, N76G, F227L and E229N | N61D, T63I, Q64K, V74K, H146S, F227L and E229N | N61D, T63I, Q64K, N76G, H146S, F227L and E229N | N61D, T63I, V74K, N76G, H146S, F227L and E229N | N61D, Q64K, V74K, N76G, H146S, F227L and E229N |
| T63I, Q64K, V74K, N76G, H146S, F227L and E229N | A60T, N61D, T63I, Q64K, V74K, N76G, H146S and F227L | A60T, N61D, T63I, Q64K, V74K, N76G, H146S and E229N | A60T, N61D, T63I, Q64K, V74K, N76G, F227L and E229N | A60T, N61D, T63I, Q64K, V74K, H146S, F227L and E229N |
| A60T, N61D, T63I, Q64K, N76G, H146S, F227L and E229N | A60T, N61D, T63I, V74K, N76G, H146S, F227L and E229N | A60T, N61D, T63I, Q64K, V74K, N76G, H146S, F227L and E229N | A60T, T63I, Q64K, V74K, N76G, H146S, F227L and E229N | N61D, T63I, Q64K, V74K, N76G, H146S, F227L and E229N |
| A60T, N61D, T63I, Q64K, V74K, N76G, H146S, F227L and E229NT85L, H121Y, N130K, M134L, E154D, N190D and H225Y | T85L, H121Y, N130K, M134L, E154D, N190D and N229E | T85L, H121Y, N130K, M134L, E154D, N190D and V258G | T85L, H121Y, N130K, M134L, E154D, N190D and A289P | T85L, H121Y, N130K, M134L, E154D, N190D and N303S |
| T85L, H121Y, N130K, M134L, E154D, N190D and N336Q | T85L, H121Y, N130K, M134L, E154D, H225Y and N229E | T85L, H121Y, N130K, M134L, E154D, H225Y and V258G | T85L, H121Y, N130K, M134L, E154D, H225Y and A289P | T85L, H121Y, N130K, M134L, E154D, H225Y and N303S |
| T85L, H121Y, N130K, M134L, E154D, H225Y and N336Q | T85L, H121Y, N130K, M134L, E154D, N229E and V258G | T85L, H121Y, N130K, M134L, E154D, N229E and A289P | T85L, H121Y, N130K, M134L, E154D, N229E and N303S | T85L, H121Y, N130K, M134L, E154D, N229E and N336Q |
| T85L, H121Y, N130K, M134L, E154D, V258G and A289P | T85L, H121Y, N130K, M134L, E154D, V258G and N303S | T85L, H121Y, N130K, M134L, E154D, V258G and N336Q | T85L, H121Y, N130K, M134L, E154D, A289P and N303S | T85L, H121Y, N130K, M134L, E154D, A289P and N336Q |
| T85L, H121Y, N130K, M134L, E154D, N303S and N336Q | T85L, H121Y, N130K, M134L, N190D, H225Y and N229E | T85L, H121Y, N130K, M134L, N190D, H225Y and V258G | T85L, H121Y, N130K, M134L, N190D, H225Y and A289P | T85L, H121Y, N130K, M134L, N190D, H225Y and N303S |
| T85L, H121Y, N130K, M134L, N190D, H225Y and N336Q | T85L, H121Y, N130K, M134L, N190D, N229E and V258G | T85L, H121Y, N130K, M134L, N190D, N229E and A289P | T85L, H121Y, N130K, M134L, N190D, N229E and N303S | T85L, H121Y, N130K, M134L, N190D, N229E and N336Q |
| T85L, H121Y, N130K, M134L, N190D, V258G and A289P | T85L, H121Y, N130K, M134L, N190D, V258G and N303S | T85L, H121Y, N130K, M134L, N190D, V258G and N336Q | T85L, H121Y, N130K, M134L, N190D, A289P and N303S | T85L, H121Y, N130K, M134L, N190D, A289P and N336Q |
| T85L, H121Y, N130K, M134L, N190D, N303S and N336Q | T85L, H121Y, N130K, M134L, H225Y, N229E and V258G | T85L, H121Y, N130K, M134L, H225Y, N229E and A289P | T85L, H121Y, N130K, M134L, H225Y, N229E and N303S | T85L, H121Y, N130K, M134L, H225Y, N229E and N336Q |
| T85L, H121Y, N130K, M134L, H225Y, V258G and A289P | T85L, H121Y, N130K, M134L, H225Y, V258G and N303S | T85L, H121Y, N130K, M134L, H225Y, V258G and N336Q | T85L, H121Y, N130K, M134L, H225Y, A289P and N303S | T85L, H121Y, N130K, M134L, H225Y, A289P and N336Q |
| T85L, H121Y, N130K, M134L, H225Y, N303S and N336Q | T85L, H121Y, N130K, M134L, N229E, V258G and A289P | T85L, H121Y, N130K, M134L, N229E, V258G and N303S | T85L, H121Y, N130K, M134L, N229E, V258G and N336Q | T85L, H121Y, N130K, M134L, N229E, A289P and N303S |
| T85L, H121Y, N130K, M134L, N229E, A289P and N336Q | T85L, H121Y, N130K, M134L, N229E, N303S and N336Q | T85L, H121Y, N130K, M134L, V258G, A289P and N303S | T85L, H121Y, N130K, M134L, V258G, A289P and N336Q | T85L, H121Y, N130K, M134L, V258G, N303S and N336Q |
| T85L, H121Y, N130K, M134L, A289P, N303S and N336Q | T85L, H121Y, N130K, E154D, N190D, H225Y and N229E | T85L, H121Y, N130K, E154D, N190D, H225Y and V258G | T85L, H121Y, N130K, E154D, N190D, H225Y and A289P | T85L, H121Y, N130K, E154D, N190D, H225Y and N303S |
| T85L, H121Y, N130K, E154D, N190D, H225Y and N336Q | T85L, H121Y, N130K, E154D, N190D, N229E and V258G | T85L, H121Y, N130K, E154D, N190D, N229E and A289P | T85L, H121Y, N130K, E154D, N190D, N229E and N303S | T85L, H121Y, N130K, E154D, N190D, N229E and N336Q |
| T85L, H121Y, N130K, E154D, N190D, V258G and A289P | T85L, H121Y, N130K, E154D, N190D, V258G and N303S | T85L, H121Y, N130K, E154D, N190D, V258G and N336Q | T85L, H121Y, N130K, E154D, N190D, A289P and N303S | T85L, H121Y, N130K, E154D, N190D, A289P and N336Q |
| T85L, H121Y, N130K, E154D, N190D, N303S and N336Q | T85L, H121Y, N130K, E154D, H225Y, N229E and V258G | T85L, H121Y, N130K, E154D, H225Y, N229E and A289P | T85L, H121Y, N130K, E154D, H225Y, N229E and N303S | T85L, H121Y, N130K, E154D, H225Y, N229E and N336Q |
| T85L, H121Y, N130K, E154D, H225Y, V258G and A289P | T85L, H121Y, N130K, E154D, H225Y, V258G and N303S | T85L, H121Y, N130K, E154D, H225Y, V258G and N336Q | T85L, H121Y, N130K, E154D, H225Y, A289P and N303S | T85L, H121Y, N130K, E154D, H225Y, A289P and N336Q |
| T85L, H121Y, N130K, E154D, H225Y, N303S and N336Q | T85L, H121Y, N130K, E154D, N229E, V258G and A289P | T85L, H121Y, N130K, E154D, N229E, V258G and N303S | T85L, H121Y, N130K, E154D, N229E, V258G and N336Q | T85L, H121Y, N130K, E154D, N229E, A289P and N303S |
| T85L, H121Y, N130K, E154D, N229E, A289P and N336Q | T85L, H121Y, N130K, E154D, N229E, N303S and N336Q | T85L, H121Y, N130K, E154D, V258G, A289P and N303S | T85L, H121Y, N130K, E154D, V258G, A289P and N336Q | T85L, H121Y, N130K, E154D, V258G, N303S and N336Q |
| T85L, H121Y, N130K, E154D, A289P, N303S and N336Q | T85L, H121Y, N130K, N190D, H225Y, N229E and V258G | T85L, H121Y, N130K, N190D, H225Y, N229E and A289P | T85L, H121Y, N130K, N190D, H225Y, N229E and N303S | T85L, H121Y, N130K, N190D, H225Y, N229E and N336Q |

TABLE 21-continued

Non-limiting examples of mutations [as compared to SEQ ID NO: 35]

| | | | | |
|---|---|---|---|---|
| T85L, H121Y, N130K, N190D, H225Y, V258G and A289P | T85L, H121Y, N130K, N190D, H225Y, V258G and N303S | T85L, H121Y, N130K, N190D, H225Y, V258G and N336Q | T85L, H121Y, N130K, N190D, H225Y, A289P and N303S | T85L, H121Y, N130K, N190D, H225Y, A289P and N336Q |
| T85L, H121Y, N130K, N190D, H225Y, N303S and N336Q | T85L, H121Y, N130K, N190D, N229E, V258G and A289P | T85L, H121Y, N130K, N190D, N229E, V258G and N303S | T85L, H121Y, N130K, N190D, N229E, V258G and N336Q | T85L, H121Y, N130K, N190D, N229E, A289P and N303S |
| T85L, H121Y, N130K, N190D, N229E, A289P and N336Q | T85L, H121Y, N130K, N190D, N229E, N303S and N336Q | T85L, H121Y, N130K, N190D, V258G, A289P and N303S | T85L, H121Y, N130K, N190D, V258G, A289P and N336Q | T85L, H121Y, N130K, N190D, V258G, N303S and N336Q |
| T85L, H121Y, N130K, N190D, A289P, N303S and N336Q | T85L, H121Y, N130K, H225Y, N229E, V258G and A289P | T85L, H121Y, N130K, H225Y, N229E, V258G and N303S | T85L, H121Y, N130K, H225Y, N229E, V258G and N336Q | T85L, H121Y, N130K, H225Y, N229E, A289P and N303S |
| T85L, H121Y, N130K, H225Y, N229E, A289P and N336Q | T85L, H121Y, N130K, H225Y, N229E, N303S and N336Q | T85L, H121Y, N130K, H225Y, V258G, A289P and N303S | T85L, H121Y, N130K, H225Y, V258G, A289P and N336Q | T85L, H121Y, N130K, H225Y, V258G, N303S and N336Q |
| T85L, H121Y, N130K, H225Y, A289P, N303S and N336Q | T85L, H121Y, N130K, N229E, V258G, A289P and N303S | T85L, H121Y, N130K, N229E, V258G, A289P and N336Q | T85L, H121Y, N130K, N229E, V258G, N303S and N336Q | T85L, H121Y, N130K, N229E, A289P, N303S and N336Q |
| T85L, H121Y, N130K, V258G, A289P, N303S and N336Q | T85L, H121Y, M134L, E154D, N190D, H225Y and N229E | T85L, H121Y, M134L, E154D, N190D, H225Y and V258G | T85L, H121Y, M134L, E154D, N190D, H225Y and A289P | T85L, H121Y, M134L, E154D, N190D, H225Y and N303S |
| T85L, H121Y, M134L, E154D, N190D, H225Y and N336Q | T85L, H121Y, M134L, E154D, N190D, N229E and V258G | T85L, H121Y, M134L, E154D, N190D, N229E and A289P | T85L, H121Y, M134L, E154D, N190D, N229E and N303S | T85L, H121Y, M134L, E154D, N190D, N229E and N336Q |
| T85L, H121Y, M134L, E154D, N190D, V258G and A289P | T85L, H121Y, M134L, E154D, N190D, V258G and N303S | T85L, H121Y, M134L, E154D, N190D, V258G and N336Q | T85L, H121Y, M134L, E154D, N190D, A289P and N303S | T85L, H121Y, M134L, E154D, N190D, A289P and N336Q |
| T85L, H121Y, M134L, E154D, N190D, N303S and N336Q | T85L, H121Y, M134L, E154D, H225Y, N229E and V258G | T85L, H121Y, M134L, E154D, H225Y, N229E and A289P | T85L, H121Y, M134L, E154D, H225Y, N229E and N303S | T85L, H121Y, M134L, E154D, H225Y, N229E and N336Q |
| T85L, H121Y, M134L, E154D, H225Y, V258G and A289P | T85L, H121Y, M134L, E154D, H225Y, V258G and N303S | T85L, H121Y, M134L, E154D, H225Y, V258G and N336Q | T85L, H121Y, M134L, E154D, H225Y, A289P and N303S | T85L, H121Y, M134L, E154D, H225Y, A289P and N336Q |
| T85L, H121Y, M134L, E154D, H225Y, N303S and N336Q | T85L, H121Y, M134L, E154D, N229E, V258G and A289P | T85L, H121Y, M134L, E154D, N229E, V258G and N303S | T85L, H121Y, M134L, E154D, N229E, V258G and N336Q | T85L, H121Y, M134L, E154D, N229E, A289P and N303S |
| T85L, H121Y, M134L, E154D, N229E, A289P and N336Q | T85L, H121Y, M134L, E154D, N229E, N303S and N336Q | T85L, H121Y, M134L, E154D, V258G, A289P and N303S | T85L, H121Y, M134L, E154D, V258G, A289P and N336Q | T85L, H121Y, M134L, E154D, V258G, N303S and N336Q |
| T85L, H121Y, M134L, E154D, A289P, N303S and N336Q | T85L, H121Y, M134L, N190D, H225Y, N229E and V258G | T85L, H121Y, M134L, N190D, H225Y, N229E and A289P | T85L, H121Y, M134L, N190D, H225Y, N229E and N303S | T85L, H121Y, M134L, N190D, H225Y, N229E and N336Q |
| T85L, H121Y, M134L, N190D, H225Y, V258G and A289P | T85L, H121Y, M134L, N190D, H225Y, V258G and N303S | T85L, H121Y, M134L, N190D, H225Y, V258G and N336Q | T85L, H121Y, M134L, N190D, H225Y, A289P and N303S | T85L, H121Y, M134L, N190D, H225Y, A289P and N336Q |
| T85L, H121Y, M134L, N190D, H225Y, N303S and N336Q | T85L, H121Y, M134L, N190D, N229E, V258G and A289P | T85L, H121Y, M134L, N190D, N229E, V258G and N303S | T85L, H121Y, M134L, N190D, N229E, V258G and N336Q | T85L, H121Y, M134L, N190D, N229E, A289P and N303S |
| T85L, H121Y, M134L, N190D, N229E, A289P and N336Q | T85L, H121Y, M134L, N190D, N229E, N303S and N336Q | T85L, H121Y, M134L, N190D, V258G, A289P and N303S | T85L, H121Y, M134L, N190D, V258G, A289P and N336Q | T85L, H121Y, M134L, N190D, V258G, N303S and N336Q |
| T85L, H121Y, M134L, N190D, A289P, N303S and N336Q | T85L, H121Y, M134L, H225Y, N229E, V258G and A289P | T85L, H121Y, M134L, H225Y, N229E, V258G and N303S | T85L, H121Y, M134L, H225Y, N229E, V258G and N336Q | T85L, H121Y, M134L, H225Y, N229E, A289P and N303S |
| T85L, H121Y, M134L, H225Y, N229E, A289P and N336Q | T85L, H121Y, M134L, H225Y, N229E, N303S and N336Q | T85L, H121Y, M134L, H225Y, V258G, A289P and N303S | T85L, H121Y, M134L, H225Y, V258G, A289P and N336Q | T85L, H121Y, M134L, H225Y, V258G, N303S and N336Q |
| T85L, H121Y, M134L, H225Y, A289P, N303S and N336Q | T85L, H121Y, M134L, N229E, V258G, A289P and N303S | T85L, H121Y, M134L, N229E, V258G, A289P and N336Q | T85L, H121Y, M134L, N229E, V258G, N303S and N336Q | T85L, H121Y, M134L, N229E, A289P, N303S and N336Q |
| T85L, H121Y, M134L, V258G, A289P, N303S and N336Q | T85L, H121Y, E154D, N190D, H225Y, N229E and V258G | T85L, H121Y, E154D, N190D, H225Y, N229E and A289P | T85L, H121Y, E154D, N190D, H225Y, N229E and N303S | T85L, H121Y, E154D, N190D, H225Y, N229E and N336Q |
| T85L, H121Y, E154D, N190D, H225Y, V258G and A289P | T85L, H121Y, E154D, N190D, H225Y, V258G and N303S | T85L, H121Y, E154D, N190D, H225Y, V258G and N336Q | T85L, H121Y, E154D, N190D, H225Y, A289P and N336Q | T85L, H121Y, E154D, N190D, H225Y, A289P and N336Q |
| T85L, H121Y, E154D, N190D, H225Y, N303S and N336Q | T85L, H121Y, E154D, N190D, N229E, V258G and A289P | T85L, H121Y, E154D, N190D, N229E, V258G and N303S | T85L, H121Y, E154D, N190D, N229E, V258G and N336Q | T85L, H121Y, E154D, N190D, N229E, A289P and N303S |
| T85L, H121Y, E154D, N190D, N229E, A289P and N336Q | T85L, H121Y, E154D, N190D, N229E, N303S and N336Q | T85L, H121Y, E154D, N190D, V258G, A289P and N303S | T85L, H121Y, E154D, N190D, V258G, A289P and N336Q | T85L, H121Y, E154D, N190D, V258G, N303S and N336Q |
| T85L, H121Y, E154D, N190D, A289P, N303S and N336Q | T85L, H121Y, E154D, H225Y, N229E, V258G and A289P | T85L, H121Y, E154D, H225Y, N229E, V258G and N303S | T85L, H121Y, E154D, H225Y, N229E, V258G and N336Q | T85L, H121Y, E154D, H225Y, N229E, A289P and N303S |
| T85L, H121Y, E154D, H225Y, N229E, A289P and N336Q | T85L, H121Y, E154D, H225Y, N229E, N303S and N336Q | T85L, H121Y, E154D, H225Y, V258G, A289P and N303S | T85L, H121Y, E154D, H225Y, V258G, A289P and N336Q | T85L, H121Y, E154D, H225Y, V258G, N303S and N336Q |

TABLE 21-continued

Non-limiting examples of mutations [as compared to SEQ ID NO: 35]

| | | | | |
|---|---|---|---|---|
| T85L, H121Y, E154D, H225Y, A289P, N303S and N336Q | T85L, H121Y, E154D, N229E, V258G, A289P and N303S | T85L, H121Y, E154D, N229E, V258G, A289P and N336Q | T85L, H121Y, E154D, N229E, V258G, N303S and N336Q | T85L, H121Y, E154D, N229E, A289P, N303S and N336Q |
| T85L, H121Y, E154D, V258G, A289P, N303S and N336Q | T85L, H121Y, N190D, H225Y, N229E, V258G and A289P | T85L, H121Y, N190D, H225Y, N229E, V258G and N303S | T85L, H121Y, N190D, H225Y, N229E, V258G and N336Q | T85L, H121Y, N190D, H225Y, N229E, A289P and N303S |
| T85L, H121Y, N190D, H225Y, N229E, A289P and N336Q | T85L, H121Y, N190D, H225Y, N229E, N303S and N336Q | T85L, H121Y, N190D, H225Y, V258G, A289P and N303S | T85L, H121Y, N190D, H225Y, V258G, A289P and N336Q | T85L, H121Y, N190D, H225Y, V258G, N303S and N336Q |
| T85L, H121Y, N190D, H225Y, A289P, N303S and N336Q | T85L, H121Y, N190D, N229E, V258G, A289P and N303S | T85L, H121Y, N190D, N229E, V258G, A289P and N336Q | T85L, H121Y, N190D, N229E, V258G, N303S and N336Q | T85L, H121Y, N190D, N229E, A289P, N303S and N336Q |
| T85L, H121Y, N190D, V258G, A289P, N303S and N336Q | T85L, H121Y, H225Y, N229E, V258G, A289P and N303S | T85L, H121Y, H225Y, N229E, V258G, A289P and N336Q | T85L, H121Y, H225Y, N229E, V258G, N303S and N336Q | T85L, H121Y, H225Y, N229E, A289P, N303S and N336Q |
| T85L, H121Y, H225Y, V258G, A289P, N303S and N336Q | T85L, H121Y, N229E, V258G, A289P, N303S and N336Q | T85L, N130K, M134L, E154D, N190D, H225Y and N229E | T85L, N130K, M134L, E154D, N190D, H225Y and V258G | T85L, N130K, M134L, E154D, N190D, H225Y and A289P |
| T85L, N130K, M134L, E154D, N190D, H225Y and N303S | T85L, N130K, M134L, E154D, N190D, H225Y and N336Q | T85L, N130K, M134L, E154D, N190D, N229E and V258G | T85L, N130K, M134L, E154D, N190D, N229E and A289P | T85L, N130K, M134L, E154D, N190D, N229E and N303S |
| T85L, N130K, M134L, E154D, N190D, N229E and N336Q | T85L, N130K, M134L, E154D, N190D, V258G and A289P | T85L, N130K, M134L, E154D, N190D, V258G and N303S | T85L, N130K, M134L, E154D, N190D, V258G and N336Q | T85L, N130K, M134L, E154D, N190D, A289P and N303S |
| T85L, N130K, M134L, E154D, N190D, A289P and N336Q | T85L, N130K, M134L, E154D, N190D, N303S and N336Q | T85L, N130K, M134L, E154D, H225Y, N229E and V258G | T85L, N130K, M134L, E154D, H225Y, N229E and A289P | T85L, N130K, M134L, E154D, H225Y, N229E and N303S |
| T85L, N130K, M134L, E154D, H225Y, N229E and N336Q | T85L, N130K, M134L, E154D, H225Y, V258G and A289P | T85L, N130K, M134L, E154D, H225Y, V258G and N303S | T85L, N130K, M134L, E154D, H225Y, V258G and N336Q | T85L, N130K, M134L, E154D, H225Y, A289P and N303S |
| T85L, N130K, M134L, E154D, H225Y, A289P and N336Q | T85L, N130K, M134L, E154D, H225Y, N303S and N336Q | T85L, N130K, M134L, E154D, N229E, V258G and A289P | T85L, N130K, M134L, E154D, N229E, V258G and N303S | T85L, N130K, M134L, E154D, N229E, V258G and N336Q |
| T85L, N130K, M134L, E154D, N229E, A289P and N303S | T85L, N130K, M134L, E154D, N229E, A289P and N336Q | T85L, N130K, M134L, E154D, N229E, N303S and N336Q | T85L, N130K, M134L, E154D, V258G, A289P and N303S | T85L, N130K, M134L, E154D, V258G, A289P and N336Q |
| T85L, N130K, M134L, E154D, V258G, N303S and N336Q | T85L, N130K, M134L, E154D, A289P, N303S and N336Q | T85L, N130K, M134L, N190D, H225Y, N229E and V258G | T85L, N130K, M134L, N190D, H225Y, N229E and A289P | T85L, N130K, M134L, N190D, H225Y, N229E and N303S |
| T85L, N130K, M134L, N190D, H225Y, N229E and N336Q | T85L, N130K, M134L, N190D, H225Y, V258G and A289P | T85L, N130K, M134L, N190D, H225Y, V258G and N303S | T85L, N130K, M134L, N190D, H225Y, V258G and N336Q | T85L, N130K, M134L, N190D, H225Y, A289P and N303S |
| T85L, N130K, M134L, N190D, H225Y, A289P and N336Q | T85L, N130K, M134L, N190D, H225Y, N303S and N336Q | T85L, N130K, M134L, N190D, N229E, V258G and A289P | T85L, N130K, M134L, N190D, N229E, V258G and N303S | T85L, N130K, M134L, N190D, N229E, V258G and N336Q |
| T85L, N130K, M134L, N190D, N229E, A289P and N303S | T85L, N130K, M134L, N190D, N229E, A289P and N336Q | T85L, N130K, M134L, N190D, N229E, N303S and N336Q | T85L, N130K, M134L, N190D, V258G, A289P and N303S | T85L, N130K, M134L, N190D, V258G, A289P and N336Q |
| T85L, N130K, M134L, N190D, V258G, N303S and N336Q | T85L, N130K, M134L, N190D, A289P, N303S and N336Q | T85L, N130K, M134L, H225Y, N229E, V258G and A289P | T85L, N130K, M134L, H225Y, N229E, V258G and N303S | T85L, N130K, M134L, H225Y, N229E, V258G and N336Q |
| T85L, N130K, M134L, H225Y, N229E, A289P and N303S | T85L, N130K, M134L, H225Y, N229E, A289P and N336Q | T85L, N130K, M134L, H225Y, N229E, N303S and N336Q | T85L, N130K, M134L, H225Y, V258G, A289P and N303S | T85L, N130K, M134L, H225Y, V258G, A289P and N336Q |
| T85L, N130K, M134L, H225Y, V258G, N303S and N336Q | T85L, N130K, M134L, H225Y, A289P, N303S and N336Q | T85L, N130K, M134L, N229E, V258G, A289P and N303S | T85L, N130K, M134L, N229E, V258G, A289P and N336Q | T85L, N130K, M134L, N229E, V258G, N303S and N336Q |
| T85L, N130K, M134L, N229E, A289P, N303S and N336Q | T85L, N130K, M134L, V258G, A289P, N303S and N336Q | T85L, N130K, E154D, N190D, H225Y, N229E and V258G | T85L, N130K, E154D, N190D, H225Y, N229E and A289P | T85L, N130K, E154D, N190D, H225Y, N229E and N303S |
| T85L, N130K, E154D, N190D, H225Y, N229E and N336Q | T85L, N130K, E154D, N190D, H225Y, V258G and A289P | T85L, N130K, E154D, N190D, H225Y, V258G and N303S | T85L, N130K, E154D, N190D, H225Y, V258G and N336Q | T85L, N130K, E154D, N190D, H225Y, A289P and N303S |
| T85L, N130K, E154D, N190D, H225Y, A289P and N336Q | T85L, N130K, E154D, N190D, H225Y, N303S and N336Q | T85L, N130K, E154D, N190D, N229E, V258G and A289P | T85L, N130K, E154D, N190D, N229E, V258G and N303S | T85L, N130K, E154D, N190D, N229E, V258G and N336Q |
| T85L, N130K, E154D, N190D, N229E, A289P and N303S | T85L, N130K, E154D, N190D, N229E, A289P and N336Q | T85L, N130K, E154D, N190D, N229E, N303S and N336Q | T85L, N130K, E154D, N190D, V258G, A289P and N303S | T85L, N130K, E154D, N190D, V258G, A289P and N336Q |
| T85L, N130K, E154D, N190D, V258G, N303S and N336Q | T85L, N130K, E154D, N190D, A289P, N303S and N336Q | T85L, N130K, E154D, H225Y, N229E, V258G and A289P | T85L, N130K, E154D, H225Y, N229E, V258G and N303S | T85L, N130K, E154D, H225Y, N229E, V258G and N336Q |
| T85L, N130K, E154D, H225Y, N229E, A289P and N303S | T85L, N130K, E154D, H225Y, N229E, A289P and N336Q | T85L, N130K, E154D, H225Y, N229E, N303S and N336Q | T85L, N130K, E154D, H225Y, V258G, A289P and N303S | T85L, N130K, E154D, H225Y, V258G, A289P and N336Q |
| T85L, N130K, E154D, H225Y, V258G, N303S and N336Q | T85L, N130K, E154D, H225Y, A289P, N303S and N336Q | T85L, N130K, E154D, N229E, V258G, A289P and N303S | T85L, N130K, E154D, N229E, V258G, A289P and N336Q | T85L, N130K, E154D, N229E, V258G, N303S and N336Q |

TABLE 21-continued

Non-limiting examples of mutations [as compared to SEQ ID NO: 35]

| | | | | |
|---|---|---|---|---|
| T85L, N130K, E154D, N229E, A289P, N303S and N336Q | T85L, N130K, E154D, V258G, A289P, N303S and N336Q | T85L, N130K, N190D, H225Y, N229E, V258G and A289P | T85L, N130K, N190D, H225Y, N229E, V258G and N303S | T85L, N130K, N190D, H225Y, N229E, V258G and N336Q |
| T85L, N130K, N190D, H225Y, N229E, A289P and N303S | T85L, N130K, N190D, H225Y, N229E, A289P and N336Q | T85L, N130K, N190D, H225Y, N229E, N303S and N336Q | T85L, N130K, N190D, H225Y, V258G, A289P and N303S | T85L, N130K, N190D, H225Y, V258G, A289P and N336Q |
| T85L, N130K, N190D, H225Y, V258G, N303S and N336Q | T85L, N130K, N190D, H225Y, A289P, N303S and N336Q | T85L, N130K, N190D, N229E, V258G, A289P and N303S | T85L, N130K, N190D, N229E, V258G, A289P and N336Q | T85L, N130K, N190D, N229E, V258G, N303S and N336Q |
| T85L, N130K, N190D, N229E, A289P, N303S and N336Q | T85L, N130K, N190D, V258G, A289P, N303S and N336Q | T85L, N130K, H225Y, N229E, V258G, A289P and N303S | T85L, N130K, H225Y, N229E, V258G, A289P and N336Q | T85L, N130K, H225Y, N229E, V258G, N303S and N336Q |
| T85L, N130K, H225Y, N229E, A289P, N303S and N336Q | T85L, N130K, H225Y, V258G, A289P, N303S and N336Q | T85L, N130K, N229E, V258G, A289P, N303S and N336Q | T85L, M134L, E154D, N190D, H225Y, N229E and V258G | T85L, M134L, E154D, N190D, H225Y, N229E and A289P |
| T85L, M134L, E154D, N190D, H225Y, N229E and N303S | T85L, M134L, E154D, N190D, H225Y, N229E and N336Q | T85L, M134L, E154D, N190D, H225Y, V258G and A289P | T85L, M134L, E154D, N190D, H225Y, V258G and N303S | T85L, M134L, E154D, N190D, H225Y, V258G and N336Q |
| T85L, M134L, E154D, N190D, H225Y, A289P and N303S | T85L, M134L, E154D, N190D, H225Y, A289P and N336Q | T85L, M134L, E154D, N190D, H225Y, N303S and N336Q | T85L, M134L, E154D, N190D, N229E, V258G and A289P | T85L, M134L, E154D, N190D, N229E, V258G and N303S |
| T85L, M134L, E154D, N190D, N229E, V258G and N336Q | T85L, M134L, E154D, N190D, N229E, A289P and N303S | T85L, M134L, E154D, N190D, N229E, A289P and N336Q | T85L, M134L, E154D, N190D, N229E, N303S and N336Q | T85L, M134L, E154D, N190D, V258G, A289P and N303S |
| T85L, M134L, E154D, N190D, V258G, A289P and N336Q | T85L, M134L, E154D, N190D, V258G, N303S and N336Q | T85L, M134L, E154D, N190D, A289P, N303S and N336Q | T85L, M134L, E154D, H225Y, N229E, V258G and A289P | T85L, M134L, E154D, H225Y, N229E, V258G and N303S |
| T85L, M134L, E154D, H225Y, N229E, V258G and N336Q | T85L, M134L, E154D, H225Y, N229E, A289P and N303S | T85L, M134L, E154D, H225Y, N229E, A289P and N336Q | T85L, M134L, E154D, H225Y, N229E, N303S and N336Q | T85L, M134L, E154D, H225Y, V258G, A289P and N303S |
| T85L, M134L, E154D, H225Y, V258G, A289P and N336Q | T85L, M134L, E154D, H225Y, V258G, N303S and N336Q | T85L, M134L, E154D, H225Y, A289P, N303S and N336Q | T85L, M134L, E154D, N229E, V258G, A289P and N303S | T85L, M134L, E154D, N229E, V258G, A289P and N336Q |
| T85L, M134L, E154D, N229E, V258G, N303S and N336Q | T85L, M134L, E154D, N229E, A289P, N303S and N336Q | T85L, M134L, E154D, V258G, A289P, N303S and N336Q | T85L, M134L, N190D, H225Y, N229E, V258G and A289P | T85L, M134L, N190D, H225Y, N229E, V258G and N303S |
| T85L, M134L, N190D, H225Y, N229E, V258G and N336Q | T85L, M134L, N190D, H225Y, N229E, A289P and N303S | T85L, M134L, N190D, H225Y, N229E, A289P and N336Q | T85L, M134L, N190D, H225Y, N229E, N303S and N336Q | T85L, M134L, N190D, H225Y, V258G, A289P and N303S |
| T85L, M134L, N190D, H225Y, V258G, A289P and N336Q | T85L, M134L, N190D, H225Y, V258G, N303S and N336Q | T85L, M134L, N190D, H225Y, A289P, N303S and N336Q | T85L, M134L, N190D, N229E, V258G, A289P and N303S | T85L, M134L, N190D, N229E, V258G, A289P and N336Q |
| T85L, M134L, N190D, N229E, V258G, N303S and N336Q | T85L, M134L, N190D, N229E, A289P, N303S and N336Q | T85L, M134L, N190D, V258G, A289P, N303S and N336Q | T85L, M134L, H225Y, N229E, V258G, A289P and N303S | T85L, M134L, H225Y, N229E, V258G, A289P and N336Q |
| T85L, M134L, H225Y, N229E, V258G, N303S and N336Q | T85L, M134L, H225Y, N229E, A289P, N303S and N336Q | T85L, M134L, H225Y, V258G, A289P, N303S and N336Q | T85L, M134L, N229E, V258G, A289P, N303S and N336Q | T85L, E154D, N190D, H225Y, N229E, V258G and A289P |
| T85L, E154D, N190D, H225Y, N229E, V258G and N303S | T85L, E154D, N190D, H225Y, N229E, V258G and N336Q | T85L, E154D, N190D, H225Y, N229E, A289P and N303S | T85L, E154D, N190D, H225Y, N229E, A289P and N336Q | T85L, E154D, N190D, H225Y, N229E, N303S and N336Q |
| T85L, E154D, N190D, H225Y, V258G, A289P and N303S | T85L, E154D, N190D, H225Y, V258G, A289P and N336Q | T85L, E154D, N190D, H225Y, V258G, N303S and N336Q | T85L, E154D, N190D, H225Y, A289P, N303S and N336Q | T85L, E154D, N190D, N229E, V258G, A289P and N303S |
| T85L, E154D, N190D, N229E, V258G, A289P and N336Q | T85L, E154D, N190D, N229E, V258G, N303S and N336Q | T85L, E154D, N190D, N229E, A289P, N303S and N336Q | T85L, E154D, N190D, V258G, A289P, N303S and N336Q | T85L, E154D, H225Y, N229E, V258G, A289P and N303S |
| T85L, E154D, H225Y, N229E, V258G, A289P and N336Q | T85L, E154D, H225Y, N229E, V258G, N303S and N336Q | T85L, E154D, H225Y, N229E, A289P, N303S and N336Q | T85L, E154D, H225Y, V258G, A289P, N303S and N336Q | T85L, E154D, N229E, V258G, A289P, N303S and N336Q |
| T85L, N190D, H225Y, N229E, V258G, A289P and N303S | T85L, N190D, H225Y, N229E, V258G, A289P and N336Q | T85L, N190D, H225Y, N229E, V258G, N303S and N336Q | T85L, N190D, H225Y, N229E, A289P, N303S and N336Q | T85L, N190D, H225Y, V258G, A289P, N303S and N336Q |
| T85L, N190D, N229E, V258G, A289P, N303S and N336Q | T85L, H225Y, N229E, V258G, A289P, N303S and N336Q | H121Y, N130K, M134L, E154D, N190D, H225Y and N229E | H121Y, N130K, M134L, E154D, N190D, H225Y and V258G | H121Y, N130K, M134L, E154D, N190D, H225Y and A289P |
| H121Y, N130K, M134L, E154D, N190D, H225Y and N303S | H121Y, N130K, M134L, E154D, N190D, H225Y and N336Q | H121Y, N130K, M134L, E154D, N190D, N229E and V258G | H121Y, N130K, M134L, E154D, N190D, N229E and A289P | H121Y, N130K, M134L, E154D, N190D, N229E and N303S |
| H121Y, N130K, M134L, E154D, N190D, N229E and N336Q | H121Y, N130K, M134L, E154D, N190D, V258G and A289P | H121Y, N130K, M134L, E154D, N190D, V258G and N303S | H121Y, N130K, M134L, E154D, N190D, V258G and N336Q | H121Y, N130K, M134L, E154D, N190D, A289P and N303S |
| H121Y, N130K, M134L, E154D, N190D, A289P and N336Q | H121Y, N130K, M134L, E154D, N190D, N303S and N336Q | H121Y, N130K, M134L, E154D, H225Y, N229E and V258G | H121Y, N130K, M134L, E154D, H225Y, N229E and A289P | H121Y, N130K, M134L, E154D, H225Y, N229E and N303S |
| H121Y, N130K, M134L, E154D, H225Y, N229E and N336Q | H121Y, N130K, M134L, E154D, H225Y, V258G and A289P | H121Y, N130K, M134L, E154D, H225Y, V258G and N303S | H121Y, N130K, M134L, E154D, H225Y, V258G and N336Q | H121Y, N130K, M134L, E154D, H225Y, A289P and N303S |

TABLE 21-continued

| Non-limiting examples of mutations [as compared to SEQ ID NO: 35] | | | | |
|---|---|---|---|---|
| H121Y, N130K, M134L, E154D, H225Y, A289P and N336Q | H121Y, N130K, M134L, E154D, H225Y, N303S and N336Q | H121Y, N130K, M134L, E154D, N229E, V258G and A289P | H121Y, N130K, M134L, E154D, N229E, V258G and N336Q | H121Y, N130K, M134L, E154D, N229E, V258G and N336Q |
| H121Y, N130K, M134L, E154D, N229E, A289P and N303S | H121Y, N130K, M134L, E154D, N229E, A289P and N336Q | H121Y, N130K, M134L, E154D, N229E, N303S and N336Q | H121Y, N130K, M134L, E154D, V258G, A289P and N303S | H121Y, N130K, M134L, E154D, V258G, A289P and N336Q |
| H121Y, N130K, M134L, E154D, V258G, N303S and N336Q | H121Y, N130K, M134L, E154D, A289P, N303S and N336Q | H121Y, N130K, M134L, N190D, H225Y, N229E and V258G | H121Y, N130K, M134L, N190D, H225Y, N229E and A289P | H121Y, N130K, M134L, N190D, H225Y, N229E and N303S |
| H121Y, N130K, M134L, N190D, H225Y, N229E and N336Q | H121Y, N130K, M134L, N190D, H225Y, V258G and A289P | H121Y, N130K, M134L, N190D, H225Y, V258G and N303S | H121Y, N130K, M134L, N190D, H225Y, V258G and N336Q | H121Y, N130K, M134L, N190D, H225Y, A289P and N303S |
| H121Y, N130K, M134L, N190D, H225Y, A289P and N336Q | H121Y, N130K, M134L, N190D, H225Y, N303S and A289P | H121Y, N130K, M134L, N190D, N229E, V258G and A289P | H121Y, N130K, M134L, N190D, N229E, V258G and N303S | H121Y, N130K, M134L, N190D, N229E, V258G and N336Q |
| H121Y, N130K, M134L, N190D, N229E, A289P and N303S | H121Y, N130K, M134L, N190D, N229E, A289P and N336Q | H121Y, N130K, M134L, N190D, N229E, N303S and N336Q | H121Y, N130K, M134L, N190D, V258G, A289P and N303S | H121Y, N130K, M134L, N190D, V258G, A289P and N336Q |
| H121Y, N130K, M134L, N190D, V258G, N303S and N336Q | H121Y, N130K, M134L, N190D, A289P, N303S and N336Q | H121Y, N130K, M134L, H225Y, N229E, V258G and A289P | H121Y, N130K, M134L, H225Y, N229E, V258G and N303S | H121Y, N130K, M134L, H225Y, N229E, V258G and N336Q |
| H121Y, N130K, M134L, H225Y, N229E, A289P and N303S | H121Y, N130K, M134L, H225Y, N229E, A289P and N336Q | H121Y, N130K, M134L, H225Y, N229E, N303S and N336Q | H121Y, N130K, M134L, H225Y, V258G, A289P and N303S | H121Y, N130K, M134L, H225Y, V258G, A289P and N336Q |
| H121Y, N130K, M134L, H225Y, V258G, N303S and N336Q | H121Y, N130K, M134L, H225Y, A289P, N303S and N336Q | H121Y, N130K, M134L, N229E, V258G, A289P and N336Q | H121Y, N130K, M134L, N229E, V258G, A289P and N336Q | H121Y, N130K, M134L, N229E, V258G, N303S and N336Q |
| H121Y, N130K, M134L, N229E, A289P, N303S and N336Q | H121Y, N130K, M134L, V258G, A289P, N303S and N336Q | H121Y, N130K, E154D, N190D, H225Y, N229E and V258G | H121Y, N130K, E154D, N190D, H225Y, N229E and A289P | H121Y, N130K, E154D, N190D, H225Y, N229E and N303S |
| H121Y, N130K, E154D, N190D, H225Y, N229E and N336Q | H121Y, N130K, E154D, N190D, H225Y, V258G and A289P | H121Y, N130K, E154D, N190D, H225Y, V258G and N303S | H121Y, N130K, E154D, N190D, H225Y, V258G and N336Q | H121Y, N130K, E154D, N190D, H225Y, A289P and N303S |
| H121Y, N130K, E154D, N190D, H225Y, A289P and N336Q | H121Y, N130K, E154D, N190D, H225Y, N303S and A289P | H121Y, N130K, E154D, N190D, N229E, V258G and A289P | H121Y, N130K, E154D, N190D, N229E, V258G and N303S | H121Y, N130K, E154D, N190D, N229E, V258G and N336Q |
| H121Y, N130K, E154D, N190D, N229E, A289P and N303S | H121Y, N130K, E154D, N190D, N229E, A289P and N336Q | H121Y, N130K, E154D, N190D, N229E, N303S and N336Q | H121Y, N130K, E154D, N190D, V258G, A289P and N303S | H121Y, N130K, E154D, N190D, V258G, A289P and N336Q |
| H121Y, N130K, E154D, N190D, V258G, N303S and N336Q | H121Y, N130K, E154D, N190D, A289P, N303S and N336Q | H121Y, N130K, E154D, H225Y, N229E, V258G and A289P | H121Y, N130K, E154D, H225Y, N229E, V258G and N303S | H121Y, N130K, E154D, H225Y, N229E, V258G and N336Q |
| H121Y, N130K, E154D, H225Y, N229E, A289P and N303S | H121Y, N130K, E154D, H225Y, N229E, A289P and N336Q | H121Y, N130K, E154D, H225Y, N229E, N303S and N336Q | H121Y, N130K, E154D, H225Y, V258G, A289P and N303S | H121Y, N130K, E154D, H225Y, V258G, A289P and N336Q |
| H121Y, N130K, E154D, H225Y, V258G, N303S and N336Q | H121Y, N130K, E154D, H225Y, A289P, N303S and N336Q | H121Y, N130K, E154D, N229E, V258G, A289P and N336Q | H121Y, N130K, E154D, N229E, V258G, A289P and N336Q | H121Y, N130K, E154D, N229E, V258G, N303S and N336Q |
| H121Y, N130K, E154D, N229E, A289P, N303S and N336Q | H121Y, N130K, E154D, V258G, A289P, N303S and N336Q | H121Y, N130K, N190D, H225Y, N229E, V258G and A289P | H121Y, N130K, N190D, H225Y, N229E, V258G and N303S | H121Y, N130K, N190D, H225Y, N229E, V258G and N336Q |
| H121Y, N130K, N190D, H225Y, N229E, A289P and N303S | H121Y, N130K, N190D, H225Y, N229E, A289P and N336Q | H121Y, N130K, N190D, H225Y, N229E, N303S and N336Q | H121Y, N130K, N190D, H225Y, V258G, A289P and N303S | H121Y, N130K, N190D, H225Y, V258G, A289P and N336Q |
| H121Y, N130K, N190D, H225Y, V258G, N303S and N336Q | H121Y, N130K, N190D, H225Y, A289P, N303S and N336Q | H121Y, N130K, N190D, N229E, V258G, A289P and N303S | H121Y, N130K, N190D, N229E, V258G, A289P and N336Q | H121Y, N130K, N190D, N229E, V258G, N303S and N336Q |
| H121Y, N130K, N190D, N229E, A289P, N303S and N336Q | H121Y, N130K, N190D, V258G, A289P, N303S and N336Q | H121Y, N130K, H225Y, N229E, V258G, A289P and N303S | H121Y, N130K, H225Y, N229E, V258G, A289P and N336Q | H121Y, N130K, H225Y, N229E, V258G, N303S and N336Q |
| H121Y, N130K, H225Y, N229E, A289P, N303S and N336Q | H121Y, N130K, H225Y, V258G, A289P, N303S and N336Q | H121Y, N130K, N229E, V258G, A289P, N303S and N336Q | H121Y, M134L, E154D, N190D, H225Y, N229E and V258G | H121Y, M134L, E154D, N190D, H225Y, N229E and A289P |
| H121Y, M134L, E154D, N190D, H225Y, N229E and N303S | H121Y, M134L, E154D, N190D, H225Y, N229E and N336Q | H121Y, M134L, E154D, N190D, H225Y, V258G and A289P | H121Y, M134L, E154D, N190D, H225Y, V258G and N303S | H121Y, M134L, E154D, N190D, H225Y, V258G and N336Q |
| H121Y, M134L, E154D, N190D, H225Y, A289P and N303S | H121Y, M134L, E154D, N190D, H225Y, A289P and N336Q | H121Y, M134L, E154D, N190D, H225Y, N303S and N336Q | H121Y, M134L, E154D, N190D, N229E, V258G and A289P | H121Y, M134L, E154D, N190D, N229E, V258G and N303S |
| H121Y, M134L, E154D, N190D, N229E, V258G and N336Q | H121Y, M134L, E154D, N190D, N229E, A289P and N303S | H121Y, M134L, E154D, N190D, N229E, A289P and N336Q | H121Y, M134L, E154D, N190D, N229E, N303S and N336Q | H121Y, M134L, E154D, N190D, V258G, A289P and N303S |
| H121Y, M134L, E154D, N190D, V258G, A289P and N336Q | H121Y, M134L, E154D, N190D, V258G, N303S and N336Q | H121Y, M134L, E154D, N190D, A289P, N303S and N336Q | H121Y, M134L, E154D, H225Y, N229E, V258G and A289P | H121Y, M134L, E154D, H225Y, N229E, V258G and N303S |
| H121Y, M134L, E154D, H225Y, N229E, V258G and N336Q | H121Y, M134L, E154D, H225Y, N229E, A289P and N303S | H121Y, M134L, E154D, H225Y, N229E, A289P and N336Q | H121Y, M134L, E154D, H225Y, N229E, N303S and N336Q | H121Y, M134L, E154D, H225Y, V258G, A289P and N303S |

TABLE 21-continued

Non-limiting examples of mutations [as compared to SEQ ID NO: 35]

| | | | | |
|---|---|---|---|---|
| H121Y, M134L, E154D, H225Y, V258G, A289P and N336Q | H121Y, M134L, E154D, H225Y, V258G, N303S and N336Q | H121Y, M134L, E154D, H225Y, A289P, N303S and N336Q | H121Y, M134L, E154D, N229E, V258G, A289P and N303S | H121Y, M134L, E154D, N229E, V258G, A289P and N336Q |
| H121Y, M134L, E154D, N229E, V258G, N303S and N336Q | H121Y, M134L, E154D, N229E, A289P, N303S and N336Q | H121Y, M134L, E154D, V258G, A289P, N303S and N336Q | H121Y, M134L, N190D, H225Y, N229E, V258G and A289P | H121Y, M134L, N190D, H225Y, N229E, V258G and N303S |
| H121Y, M134L, N190D, H225Y, N229E, V258G and N336Q | H121Y, M134L, N190D, H225Y, N229E, A289P and N303S | H121Y, M134L, N190D, H225Y, N229E, A289P and N336Q | H121Y, M134L, N190D, H225Y, N229E, N303S and N336Q | H121Y, M134L, N190D, H225Y, V258G, A289P and N303S |
| H121Y, M134L, N190D, H225Y, V258G, A289P and N336Q | H121Y, M134L, N190D, H225Y, V258G, N303S and N336Q | H121Y, M134L, N190D, H225Y, A289P, N303S and N336Q | H121Y, M134L, N190D, N229E, V258G, A289P and N303S | H121Y, M134L, N190D, N229E, V258G, A289P and N336Q |
| H121Y, M134L, N190D, N229E, V258G, N303S and N336Q | H121Y, M134L, N190D, N229E, A289P, N303S and N336Q | H121Y, M134L, N190D, V258G, A289P, N303S and N336Q | H121Y, M134L, H225Y, N229E, V258G, A289P and N303S | H121Y, M134L, H225Y, N229E, V258G, A289P and N336Q |
| H121Y, M134L, H225Y, N229E, V258G, N303S and N336Q | H121Y, M134L, H225Y, N229E, A289P, N303S and N336Q | H121Y, M134L, H225Y, V258G, A289P, N303S and N336Q | H121Y, M134L, N229E, V258G, A289P, N303S and N336Q | H121Y, E154D, N190D, H225Y, N229E, V258G and A289P |
| H121Y, E154D, N190D, H225Y, N229E, V258G and N303S | H121Y, E154D, N190D, H225Y, N229E, V258G and N336Q | H121Y, E154D, N190D, H225Y, N229E, A289P and N303S | H121Y, E154D, N190D, H225Y, N229E, A289P and N336Q | H121Y, E154D, N190D, H225Y, N229E, N303S and N336Q |
| H121Y, E154D, N190D, H225Y, V258G, A289P and N303S | H121Y, E154D, N190D, H225Y, V258G, A289P and N336Q | H121Y, E154D, N190D, H225Y, V258G, N303S and N336Q | H121Y, E154D, N190D, H225Y, A289P, N303S and N336Q | H121Y, E154D, N190D, N229E, V258G, A289P and N303S |
| H121Y, E154D, N190D, N229E, V258G, A289P and N336Q | H121Y, E154D, N190D, N229E, V258G, N303S and N336Q | H121Y, E154D, N190D, N229E, A289P, N303S and N336Q | H121Y, E154D, N190D, V258G, A289P, N303S and N336Q | H121Y, E154D, H225Y, N229E, V258G, A289P and N303S |
| H121Y, E154D, H225Y, N229E, V258G, A289P and N336Q | H121Y, E154D, H225Y, N229E, V258G, N303S and N336Q | H121Y, E154D, H225Y, N229E, A289P, N303S and N336Q | H121Y, E154D, H225Y, V258G, A289P, N303S and N336Q | H121Y, E154D, N229E, V258G, A289P, N303S and N336Q |
| H121Y, N190D, H225Y, N229E, V258G, A289P and N303S | H121Y, N190D, H225Y, N229E, V258G, A289P and N336Q | H121Y, N190D, H225Y, N229E, V258G, N303S and N336Q | H121Y, N190D, H225Y, N229E, A289P, N303S and N336Q | H121Y, N190D, H225Y, V258G, A289P, N303S and N336Q |
| H121Y, N190D, N229E, V258G, A289P, N303S and N336Q | H121Y, H225Y, N229E, V258G, A289P, N303S and N336Q | N130K, M134L, E154D, N190D, H225Y, N229E and V258G | N130K, M134L, E154D, N190D, H225Y, N229E and A289P | N130K, M134L, E154D, N190D, H225Y, N229E and N303S |
| N130K, M134L, E154D, N190D, H225Y, N229E and N336Q | N130K, M134L, E154D, N190D, H225Y, V258G and A289P | N130K, M134L, E154D, N190D, H225Y, V258G and N303S | N130K, M134L, E154D, N190D, H225Y, V258G and N336Q | N130K, M134L, E154D, N190D, H225Y, A289P and N303S |
| N130K, M134L, E154D, N190D, H225Y, A289P and N336Q | N130K, M134L, E154D, N190D, H225Y, N303S and N336Q | N130K, M134L, E154D, N190D, N229E, V258G and A289P | N130K, M134L, E154D, N190D, N229E, V258G and N303S | N130K, M134L, E154D, N190D, N229E, V258G and N336Q |
| N130K, M134L, E154D, N190D, N229E, A289P and N303S | N130K, M134L, E154D, N190D, N229E, A289P and N336Q | N130K, M134L, E154D, N190D, N229E, N303S and N336Q | N130K, M134L, E154D, N190D, V258G, A289P and N303S | N130K, M134L, E154D, N190D, V258G, A289P and N336Q |
| N130K, M134L, E154D, N190D, V258G, N303S and N336Q | N130K, M134L, E154D, N190D, A289P, N303S and N336Q | N130K, M134L, E154D, H225Y, N229E, V258G and A289P | N130K, M134L, E154D, H225Y, N229E, V258G and N303S | N130K, M134L, E154D, H225Y, N229E, V258G and N336Q |
| N130K, M134L, E154D, H225Y, N229E, A289P and N303S | N130K, M134L, E154D, H225Y, N229E, A289P and N336Q | N130K, M134L, E154D, H225Y, N229E, N303S and N336Q | N130K, M134L, E154D, H225Y, V258G, A289P and N303S | N130K, M134L, E154D, H225Y, V258G, A289P and N336Q |
| N130K, M134L, E154D, H225Y, V258G, N303S and N336Q | N130K, M134L, E154D, H225Y, A289P, N303S and N336Q | N130K, M134L, E154D, N229E, V258G, A289P and N303S | N130K, M134L, E154D, N229E, V258G, A289P and N336Q | N130K, M134L, E154D, N229E, V258G, N303S and N336Q |
| N130K, M134L, E154D, N229E, A289P, N303S and N336Q | N130K, M134L, E154D, V258G, A289P, N303S and N336Q | N130K, M134L, N190D, H225Y, N229E, V258G and A289P | N130K, M134L, N190D, H225Y, N229E, V258G and N303S | N130K, M134L, N190D, H225Y, N229E, V258G and N336Q |
| N130K, M134L, N190D, H225Y, N229E, A289P and N303S | N130K, M134L, N190D, H225Y, N229E, A289P and N336Q | N130K, M134L, N190D, H225Y, N229E, N303S and N336Q | N130K, M134L, N190D, H225Y, V258G, A289P and N303S | N130K, M134L, N190D, H225Y, V258G, A289P and N336Q |
| N130K, M134L, N190D, H225Y, V258G, N303S and N336Q | N130K, M134L, N190D, H225Y, A289P, N303S and N336Q | N130K, M134L, N190D, N229E, V258G, A289P and N303S | N130K, M134L, N190D, N229E, V258G, A289P and N336Q | N130K, M134L, N190D, N229E, V258G, N303S and N336Q |
| N130K, M134L, N190D, N229E, A289P, N303S and N336Q | N130K, M134L, N190D, V258G, A289P, N303S and N336Q | N130K, M134L, H225Y, N229E, V258G, A289P and N303S | N130K, M134L, H225Y, N229E, V258G, A289P and N336Q | N130K, M134L, H225Y, N229E, V258G, N303S and N336Q |
| N130K, M134L, H225Y, N229E, A289P, N303S and N336Q | N130K, M134L, H225Y, V258G, A289P, N303S and N336Q | N130K, M134L, N229E, V258G, A289P, N303S and N336Q | N130K, E154D, N190D, H225Y, N229E, V258G and A289P | N130K, E154D, N190D, H225Y, N229E, V258G and N303S |
| N130K, E154D, N190D, H225Y, N229E, V258G and N336Q | N130K, E154D, N190D, H225Y, N229E, A289P and N303S | N130K, E154D, N190D, H225Y, N229E, A289P and N336Q | N130K, E154D, N190D, H225Y, N229E, N303S and N336Q | N130K, E154D, N190D, H225Y, V258G, A289P and N303S |
| N130K, E154D, N190D, H225Y, V258G, A289P and N336Q | N130K, E154D, N190D, H225Y, V258G, N303S and N336Q | N130K, E154D, N190D, H225Y, A289P, N303S and N336Q | N130K, E154D, N190D, N229E, V258G, A289P and N303S | N130K, E154D, N190D, N229E, V258G, A289P and N336Q |
| N130K, E154D, N190D, N229E, V258G, N303S and N336Q | N130K, E154D, N190D, N229E, A289P, N303S and N336Q | N130K, E154D, N190D, V258G, A289P, N303S and N336Q | N130K, E154D, H225Y, N229E, V258G, A289P and N303S | N130K, E154D, H225Y, N229E, V258G, A289P and N336Q |

TABLE 21-continued

Non-limiting examples of mutations [as compared to SEQ ID NO: 35]

| | | | | |
|---|---|---|---|---|
| N130K, E154D, H225Y, N229E, V258G, N303S and N336Q | N130K, E154D, H225Y, N229E, A289P, N303S and N336Q | N130K, E154D, H225Y, V258G, A289P, N303S and N336Q | N130K, E154D, N229E, V258G, A289P, N303S and N336Q | N130K, N190D, H225Y, N229E, V258G, A289P and N303S |
| N130K, N190D, H225Y, N229E, V258G, A289P and N336Q | N130K, N190D, H225Y, N229E, V258G, N303S and N336Q | N130K, N190D, H225Y, N229E, A289P, N303S and N336Q | N130K, N190D, H225Y, V258G, A289P, N303S and N336Q | N130K, N190D, N229E, V258G, A289P, N303S and N336Q |
| N130K, H225Y, N229E, V258G, A289P, N303S and N336Q | M134L, E154D, N190D, H225Y, N229E, V258G and A289P | M134L, E154D, N190D, H225Y, N229E, V258G and N303S | M134L, E154D, N190D, H225Y, N229E, V258G and N336Q | M134L, E154D, N190D, H225Y, N229E, A289P and N303S |
| M134L, E154D, N190D, H225Y, N229E, A289P and N336Q | M134L, E154D, N190D, H225Y, N229E, N303S and N336Q | M134L, E154D, N190D, H225Y, V258G, A289P and N303S | M134L, E154D, N190D, H225Y, V258G, A289P and N336Q | M134L, E154D, N190D, H225Y, V258G, N303S and N336Q |
| M134L, E154D, N190D, H225Y, A289P, N303S and N336Q | M134L, E154D, N190D, N229E, V258G, A289P and N303S | M134L, E154D, N190D, N229E, V258G, A289P and N336Q | M134L, E154D, N190D, N229E, V258G, N303S and N336Q | M134L, E154D, N190D, N229E, A289P, N303S and N336Q |
| M134L, E154D, N190D, V258G, A289P, N303S and N336Q | M134L, E154D, H225Y, N229E, V258G, A289P and N303S | M134L, E154D, H225Y, N229E, V258G, A289P and N336Q | M134L, E154D, H225Y, N229E, V258G, N303S and N336Q | M134L, E154D, H225Y, N229E, A289P, N303S and N336Q |
| M134L, E154D, H225Y, V258G, A289P, N303S and N336Q | M134L, E154D, N229E, V258G, A289P, N303S and N336Q | M134L, N190D, H225Y, N229E, V258G, A289P and N303S | M134L, N190D, H225Y, N229E, V258G, A289P and N336Q | M134L, N190D, H225Y, N229E, V258G, N303S and N336Q |
| M134L, N190D, H225Y, N229E, A289P, N303S and N336Q | M134L, N190D, H225Y, V258G, A289P, N303S and N336Q | M134L, N190D, N229E, V258G, A289P, N303S and N336Q | M134L, H225Y, N229E, V258G, A289P, N303S and N336Q | E154D, N190D, H225Y, N229E, V258G, A289P and N303S |
| E154D, N190D, H225Y, N229E, V258G, A289P and N336Q | E154D, N190D, H225Y, N229E, V258G, N303S and N336Q | E154D, N190D, H225Y, N229E, A289P, N303S and N336Q | E154D, N190D, H225Y, V258G, A289P, N303S and N336Q | E154D, N190D, N229E, V258G, A289P, N303S and N336Q |
| E154D, H225Y, N229E, V258G, A289P, N303S and N336Q | N190D, H225Y, N229E, V258G, A289P, N303S and N336Q | T85L, H121Y, N130K, M134L, E154D, N190D, H225Y and N229E | T85L, H121Y, N130K, M134L, E154D, N190D, H225Y and V258G | T85L, H121Y, N130K, M134L, E154D, N190D, H225Y and A289P |
| T85L, H121Y, N130K, M134L, E154D, N190D, H225Y and N303S | T85L, H121Y, N130K, M134L, E154D, N190D, H225Y and N336Q | T85L, H121Y, N130K, M134L, E154D, N190D, N229E and V258G | T85L, H121Y, N130K, M134L, E154D, N190D, N229E and A289P | T85L, H121Y, N130K, M134L, E154D, N190D, N229E and N303S |
| T85L, H121Y, N130K, M134L, E154D, N190D, N229E and N336Q | T85L, H121Y, N130K, M134L, E154D, N190D, V258G and A289P | T85L, H121Y, N130K, M134L, E154D, N190D, V258G and N303S | T85L, H121Y, N130K, M134L, E154D, N190D, V258G and N336Q | T85L, H121Y, N130K, M134L, E154D, N190D, A289P and N303S |
| T85L, H121Y, N130K, M134L, E154D, N190D, A289P and N336Q | T85L, H121Y, N130K, M134L, E154D, N190D, N303S and N336Q | T85L, H121Y, N130K, M134L, E154D, H225Y, N229E and V258G | T85L, H121Y, N130K, M134L, E154D, H225Y, N229E and A289P | T85L, H121Y, N130K, M134L, E154D, H225Y, N229E and N303S |
| T85L, H121Y, N130K, M134L, E154D, H225Y, N229E and N336Q | T85L, H121Y, N130K, M134L, E154D, H225Y, V258G and A289P | T85L, H121Y, N130K, M134L, E154D, H225Y, V258G and N303S | T85L, H121Y, N130K, M134L, E154D, H225Y, V258G and N336Q | T85L, H121Y, N130K, M134L, E154D, H225Y, A289P and N303S |
| T85L, H121Y, N130K, M134L, E154D, H225Y, A289P and N336Q | T85L, H121Y, N130K, M134L, E154D, H225Y, N303S and N336Q | T85L, H121Y, N130K, M134L, E154D, N229E, V258G and A289P | T85L, H121Y, N130K, M134L, E154D, N229E, V258G and N303S | T85L, H121Y, N130K, M134L, E154D, N229E, V258G and N336Q |
| T85L, H121Y, N130K, M134L, E154D, N229E, A289P and N303S | T85L, H121Y, N130K, M134L, E154D, N229E, A289P and N336Q | T85L, H121Y, N130K, M134L, E154D, N229E, N303S and N336Q | T85L, H121Y, N130K, M134L, E154D, V258G, A289P and N303S | T85L, H121Y, N130K, M134L, E154D, V258G, A289P and N336Q |
| T85L, H121Y, N130K, M134L, E154D, V258G, N303S and N336Q | T85L, H121Y, N130K, M134L, E154D, A289P, N303S and N336Q | T85L, H121Y, N130K, M134L, N190D, H225Y, N229E and V258G | T85L, H121Y, N130K, M134L, N190D, H225Y, N229E and A289P | T85L, H121Y, N130K, M134L, N190D, H225Y, N229E and N303S |
| T85L, H121Y, N130K, M134L, N190D, H225Y, N229E and N336Q | T85L, H121Y, N130K, M134L, N190D, H225Y, V258G and A289P | T85L, H121Y, N130K, M134L, N190D, H225Y, V258G and N303S | T85L, H121Y, N130K, M134L, N190D, H225Y, V258G and N336Q | T85L, H121Y, N130K, M134L, N190D, H225Y, A289P and N303S |
| T85L, H121Y, N130K, M134L, N190D, H225Y, A289P and N336Q | T85L, H121Y, N130K, M134L, N190D, H225Y, N303S and N336Q | T85L, H121Y, N130K, M134L, N190D, N229E, V258G and A289P | T85L, H121Y, N130K, M134L, N190D, N229E, V258G and N303S | T85L, H121Y, N130K, M134L, N190D, N229E, V258G and N336Q |
| T85L, H121Y, N130K, M134L, N190D, N229E, A289P and N303S | T85L, H121Y, N130K, M134L, N190D, N229E, A289P and N336Q | T85L, H121Y, N130K, M134L, N190D, N229E, N303S and N336Q | T85L, H121Y, N130K, M134L, N190D, V258G, A289P and N303S | T85L, H121Y, N130K, M134L, N190D, V258G, A289P and N336Q |
| T85L, H121Y, N130K, M134L, N190D, V258G, N303S and N336Q | T85L, H121Y, N130K, M134L, N190D, A289P, N303S and N336Q | T85L, H121Y, N130K, M134L, H225Y, N229E, V258G and A289P | T85L, H121Y, N130K, M134L, H225Y, N229E, V258G and N303S | T85L, H121Y, N130K, M134L, H225Y, N229E, V258G and N336Q |
| T85L, H121Y, N130K, M134L, H225Y, N229E, A289P and N303S | T85L, H121Y, N130K, M134L, H225Y, N229E, A289P and N336Q | T85L, H121Y, N130K, M134L, H225Y, N229E, N303S and N336Q | T85L, H121Y, N130K, M134L, H225Y, V258G, A289P and N303S | T85L, H121Y, N130K, M134L, H225Y, V258G, A289P and N336Q |
| T85L, H121Y, N130K, M134L, H225Y, V258G, N303S and N336Q | T85L, H121Y, N130K, M134L, H225Y, A289P, N303S and N336Q | T85L, H121Y, N130K, M134L, N229E, V258G, A289P and N303S | T85L, H121Y, N130K, M134L, N229E, V258G, A289P and N336Q | T85L, H121Y, N130K, M134L, N229E, V258G, N303S and N336Q |
| T85L, H121Y, N130K, M134L, N229E, A289P, N303S and N336Q | T85L, H121Y, N130K, M134L, V258G, A289P, N303S and N336Q | T85L, H121Y, N130K, E154D, N190D, H225Y, N229E and V258G | T85L, H121Y, N130K, E154D, N190D, H225Y, N229E and A289P | T85L, H121Y, N130K, E154D, N190D, H225Y, N229E and N303S |
| T85L, H121Y, N130K, E154D, N190D, H225Y, N229E and N336Q | T85L, H121Y, N130K, E154D, N190D, H225Y, V258G and A289P | T85L, H121Y, N130K, E154D, N190D, H225Y, V258G and N303S | T85L, H121Y, N130K, E154D, N190D, H225Y, V258G and N336Q | T85L, H121Y, N130K, E154D, N190D, H225Y, A289P and N303S |
| T85L, H121Y, N130K, E154D, N190D, H225Y, A289P and N336Q | T85L, H121Y, N130K, E154D, N190D, H225Y, N303S and N336Q | T85L, H121Y, N130K, E154D, N190D, N229E, V258G and A289P | T85L, H121Y, N130K, E154D, N190D, N229E, V258G and N303S | T85L, H121Y, N130K, E154D, N190D, N229E, V258G and N336Q |

TABLE 21-continued

Non-limiting examples of mutations [as compared to SEQ ID NO: 35]

| | | | | |
|---|---|---|---|---|
| T85L, H121Y, N130K, E154D, N190D, N229E, A289P and N303S | T85L, H121Y, N130K, E154D, N190D, N229E, A289P and N336Q | T85L, H121Y, N130K, E154D, N190D, N229E, N303S and N336Q | T85L, H121Y, N130K, E154D, N190D, V258G, A289P and N303S | T85L, H121Y, N130K, E154D, N190D, V258G, A289P and N336Q |
| T85L, H121Y, N130K, E154D, N190D, V258G, N303S and N336Q | T85L, H121Y, N130K, E154D, N190D, A289P, N303S and N336Q | T85L, H121Y, N130K, E154D, H225Y, N229E, V258G and A289P | T85L, H121Y, N130K, E154D, H225Y, N229E, V258G and N303S | T85L, H121Y, N130K, E154D, H225Y, N229E, V258G and N336Q |
| T85L, H121Y, N130K, E154D, H225Y, N229E, A289P and N303S | T85L, H121Y, N130K, E154D, H225Y, N229E, A289P and N336Q | T85L, H121Y, N130K, E154D, H225Y, N229E, N303S and N336Q | T85L, H121Y, N130K, E154D, H225Y, V258G, A289P and N303S | T85L, H121Y, N130K, E154D, H225Y, V258G, A289P and N336Q |
| T85L, H121Y, N130K, E154D, H225Y, V258G, N303S and N336Q | T85L, H121Y, N130K, E154D, H225Y, A289P, N303S and N336Q | T85L, H121Y, N130K, E154D, N229E, V258G, A289P and N303S | T85L, H121Y, N130K, E154D, N229E, V258G, A289P and N336Q | T85L, H121Y, N130K, E154D, N229E, V258G, N303S and N336Q |
| T85L, H121Y, N130K, E154D, N229E, A289P, N303S and N336Q | T85L, H121Y, N130K, E154D, V258G, A289P, N303S and N336Q | T85L, H121Y, N130K, N190D, H225Y, N229E, V258G and A289P | T85L, H121Y, N130K, N190D, H225Y, N229E, V258G and N303S | T85L, H121Y, N130K, N190D, H225Y, N229E, V258G and N336Q |
| T85L, H121Y, N130K, N190D, H225Y, N229E, A289P and N303S | T85L, H121Y, N130K, N190D, H225Y, N229E, A289P and N336Q | T85L, H121Y, N130K, N190D, H225Y, N229E, N303S and N336Q | T85L, H121Y, N130K, N190D, H225Y, V258G, A289P and N303S | T85L, H121Y, N130K, N190D, H225Y, V258G, A289P and N336Q |
| T85L, H121Y, N130K, N190D, H225Y, V258G, N303S and N336Q | T85L, H121Y, N130K, N190D, H225Y, A289P, N303S and N336Q | T85L, H121Y, N130K, N190D, N229E, V258G, A289P and N303S | T85L, H121Y, N130K, N190D, N229E, V258G, A289P and N336Q | T85L, H121Y, N130K, N190D, N229E, V258G, N303S and N336Q |
| T85L, H121Y, N130K, N190D, N229E, A289P, N303S and N336Q | T85L, H121Y, N130K, N190D, V258G, A289P, N303S and N336Q | T85L, H121Y, N130K, H225Y, V258G, N229E, A289P and N303S | T85L, H121Y, N130K, H225Y, N229E, V258G, A289P and N336Q | T85L, H121Y, N130K, H225Y, N229E, V258G, N303S and N336Q |
| T85L, H121Y, N130K, H225Y, N229E, A289P, N303S and N336Q | T85L, H121Y, N130K, H225Y, V258G, A289P, N303S and N336Q | T85L, H121Y, N130K, N229E, V258G, A289P, N303S and N336Q | T85L, H121Y, M134L, E154D, N190D, H225Y, N229E and V258G | T85L, H121Y, M134L, E154D, N190D, H225Y, N229E and A289P |
| T85L, H121Y, M134L, E154D, N190D, H225Y, N229E and N303S | T85L, H121Y, M134L, E154D, N190D, H225Y, N229E and N336Q | T85L, H121Y, M134L, E154D, N190D, H225Y, V258G and A289P | T85L, H121Y, M134L, E154D, N190D, H225Y, V258G and N303S | T85L, H121Y, M134L, E154D, N190D, H225Y, V258G and N336Q |
| T85L, H121Y, M134L, E154D, N190D, H225Y, A289P and N303S | T85L, H121Y, M134L, E154D, N190D, H225Y, A289P and N336Q | T85L, H121Y, M134L, E154D, N190D, H225Y, N303S and N336Q | T85L, H121Y, M134L, E154D, N190D, N229E, V258G and A289P | T85L, H121Y, M134L, E154D, N190D, N229E, V258G and N303S |
| T85L, H121Y, M134L, E154D, N190D, N229E, V258G and N336Q | T85L, H121Y, M134L, E154D, N190D, N229E, A289P and N303S | T85L, H121Y, M134L, E154D, N190D, N229E, A289P and N336Q | T85L, H121Y, M134L, E154D, N190D, N229E, N303S and N336Q | T85L, H121Y, M134L, E154D, N190D, V258G, A289P and N303S |
| T85L, H121Y, M134L, E154D, N190D, V258G, A289P and N336Q | T85L, H121Y, M134L, E154D, N190D, V258G, N303S and N336Q | T85L, H121Y, M134L, E154D, N190D, A289P, N303S and N336Q | T85L, H121Y, M134L, E154D, H225Y, N229E, V258G and A289P | T85L, H121Y, M134L, E154D, H225Y, N229E, V258G and N303S |
| T85L, H121Y, M134L, E154D, H225Y, N229E, V258G and N336Q | T85L, H121Y, M134L, E154D, H225Y, N229E, A289P and N303S | T85L, H121Y, M134L, E154D, H225Y, N229E, A289P and N336Q | T85L, H121Y, M134L, E154D, H225Y, N229E, N303S and N336Q | T85L, H121Y, M134L, E154D, H225Y, V258G, A289P and N303S |
| T85L, H121Y, M134L, E154D, H225Y, V258G, A289P and N336Q | T85L, H121Y, M134L, E154D, H225Y, V258G, N303S and N336Q | T85L, H121Y, M134L, E154D, H225Y, A289P, N303S and N336Q | T85L, H121Y, M134L, E154D, N229E, V258G, A289P and N303S | T85L, H121Y, M134L, E154D, N229E, V258G, A289P and N336Q |
| T85L, H121Y, M134L, E154D, N229E, V258G, N303S and N336Q | T85L, H121Y, M134L, E154D, N229E, A289P, N303S and N336Q | T85L, H121Y, M134L, E154D, V258G, A289P, N303S and N336Q | T85L, H121Y, M134L, N190D, H225Y, N229E, V258G and A289P | T85L, H121Y, M134L, N190D, H225Y, N229E, V258G and N303S |
| T85L, H121Y, M134L, N190D, H225Y, N229E, V258G and N336Q | T85L, H121Y, M134L, N190D, H225Y, N229E, A289P and N303S | T85L, H121Y, M134L, N190D, H225Y, N229E, A289P and N336Q | T85L, H121Y, M134L, N190D, H225Y, N229E, N303S and N336Q | T85L, H121Y, M134L, N190D, H225Y, V258G, A289P and N303S |
| T85L, H121Y, M134L, N190D, H225Y, V258G, A289P and N336Q | T85L, H121Y, M134L, N190D, H225Y, V258G, N303S and N336Q | T85L, H121Y, M134L, N190D, H225Y, A289P, N303S and N336Q | T85L, H121Y, M134L, N190D, N229E, V258G, A289P and N303S | T85L, H121Y, M134L, N190D, N229E, V258G, A289P and N336Q |
| T85L, H121Y, M134L, N190D, N229E, V258G, N303S and N336Q | T85L, H121Y, M134L, N190D, V258G, A289P, N303S and N336Q | T85L, H121Y, M134L, N190D, V258G, A289P, N303S and N336Q | T85L, H121Y, M134L, H225Y, N229E, V258G, A289P and N303S | T85L, H121Y, M134L, H225Y, N229E, V258G, A289P and N336Q |
| T85L, H121Y, M134L, H225Y, N229E, V258G, N303S and N336Q | T85L, H121Y, M134L, H225Y, N229E, A289P, N303S and N336Q | T85L, H121Y, M134L, H225Y, V258G, A289P, N303S and N336Q | T85L, H121Y, M134L, N229E, V258G, A289P, N303S and N336Q | T85L, H121Y, E154D, N190D, H225Y, N229E, V258G and A289P |
| T85L, H121Y, E154D, N190D, H225Y, N229E, V258G and N303S | T85L, H121Y, E154D, N190D, H225Y, N229E, V258G and N336Q | T85L, H121Y, E154D, N190D, H225Y, N229E, A289P and N303S | T85L, H121Y, E154D, N190D, H225Y, N229E, A289P and N336Q | T85L, H121Y, E154D, N190D, H225Y, N229E, N303S and N336Q |
| T85L, H121Y, E154D, N190D, H225Y, V258G, A289P and N303S | T85L, H121Y, E154D, N190D, H225Y, V258G, A289P and N336Q | T85L, H121Y, E154D, N190D, H225Y, V258G, N303S and N336Q | T85L, H121Y, E154D, N190D, H225Y, A289P, N303S and N336Q | T85L, H121Y, E154D, N190D, N229E, V258G, A289P and N303S |
| T85L, H121Y, E154D, N190D, N229E, V258G, A289P and N336Q | T85L, H121Y, E154D, N190D, N229E, V258G, N303S and N336Q | T85L, H121Y, E154D, N190D, N229E, A289P, N303S and N336Q | T85L, H121Y, E154D, N190D, V258G, A289P, N303S and N336Q | T85L, H121Y, E154D, H225Y, N229E, V258G, A289P and N303S |
| T85L, H121Y, E154D, H225Y, N229E, V258G, A289P and N336Q | T85L, H121Y, E154D, H225Y, N229E, V258G, N303S and N336Q | T85L, H121Y, E154D, H225Y, N229E, A289P, N303S and N336Q | T85L, H121Y, E154D, H225Y, V258G, A289P, N303S and N336Q | T85L, H121Y, E154D, N229E, V258G, A289P, N303S and N336Q |
| T85L, H121Y, N190D, H225Y, N229E, V258G, A289P and N303S | T85L, H121Y, N190D, H225Y, N229E, V258G, A289P and N336Q | T85L, H121Y, N190D, H225Y, N229E, V258G, N303S and N336Q | T85L, H121Y, N190D, H225Y, N229E, A289P, N303S and N336Q | T85L, H121Y, N190D, H225Y, V258G, A289P, N303S and N336Q |
| T85L, H121Y, N190D, N229E, V258G, A289P, N303S and N336Q | T85L, H121Y, H225Y, N229E, V258G, A289P, N303S and N336Q | T85L, N130K, M134L, E154D, N190D, H225Y, N229E and V258G | T85L, N130K, M134L, E154D, N190D, H225Y, N229E and A289P | T85L, N130K, M134L, E154D, N190D, H225Y, N229E and N303S |

TABLE 21-continued

Non-limiting examples of mutations [as compared to SEQ ID NO: 35]

| | | | | |
|---|---|---|---|---|
| T85L, N130K, M134L, E154D, N190D, H225Y, N229E and N336Q | T85L, N130K, M134L, E154D, N190D, H225Y, V258G and A289P | T85L, N130K, M134L, E154D, N190D, H225Y, V258G and N303S | T85L, N130K, M134L, E154D, N190D, H225Y, V258G and N336Q | T85L, N130K, M134L, E154D, N190D, H225Y, A289P and N303S |
| T85L, N130K, M134L, E154D, N190D, H225Y, A289P and N336Q | T85L, N130K, M134L, E154D, N190D, H225Y, N303S and N336Q | T85L, N130K, M134L, E154D, N190D, N229E, V258G and A289P | T85L, N130K, M134L, E154D, N190D, N229E, V258G and N303S | T85L, N130K, M134L, E154D, N190D, N229E, V258G and N336Q |
| T85L, N130K, M134L, E154D, N190D, N229E, A289P and N303S | T85L, N130K, M134L, E154D, N190D, N229E, A289P and N336Q | T85L, N130K, M134L, E154D, N190D, N229E, N303S and N336Q | T85L, N130K, M134L, E154D, N190D, V258G, A289P and N303S | T85L, N130K, M134L, E154D, N190D, V258G, A289P and N336Q |
| T85L, N130K, M134L, E154D, N190D, V258G, N303S and N336Q | T85L, N130K, M134L, E154D, N190D, A289P, N303S and N336Q | T85L, N130K, M134L, E154D, H225Y, N229E, V258G and A289P | T85L, N130K, M134L, E154D, H225Y, N229E, V258G and N303S | T85L, N130K, M134L, E154D, H225Y, N229E, V258G and N336Q |
| T85L, N130K, M134L, E154D, H225Y, N229E, A289P and N303S | T85L, N130K, M134L, E154D, H225Y, N229E, A289P and N336Q | T85L, N130K, M134L, E154D, H225Y, N229E, N303S and N336Q | T85L, N130K, M134L, E154D, H225Y, V258G, A289P and N303S | T85L, N130K, M134L, E154D, H225Y, V258G, A289P and N336Q |
| T85L, N130K, M134L, E154D, H225Y, V258G, N303S and N336Q | T85L, N130K, M134L, E154D, H225Y, A289P, N303S and N336Q | T85L, N130K, M134L, E154D, N229E, V258G, A289P and N303S | T85L, N130K, M134L, E154D, N229E, V258G, A289P and N336Q | T85L, N130K, M134L, E154D, N229E, V258G, N303S and N336Q |
| T85L, N130K, M134L, E154D, N229E, A289P, N303S and N336Q | T85L, N130K, M134L, E154D, V258G, A289P, N303S and N336Q | T85L, N130K, M134L, N190D, H225Y, N229E, V258G and A289P | T85L, N130K, M134L, N190D, H225Y, N229E, V258G and N303S | T85L, N130K, M134L, N190D, H225Y, N229E, V258G and N336Q |
| T85L, N130K, M134L, N190D, H225Y, N229E, A289P and N303S | T85L, N130K, M134L, N190D, H225Y, N229E, A289P and N336Q | T85L, N130K, M134L, N190D, H225Y, N229E, N303S and N336Q | T85L, N130K, M134L, N190D, H225Y, V258G, A289P and N303S | T85L, N130K, M134L, N190D, H225Y, V258G, A289P and N336Q |
| T85L, N130K, M134L, N190D, H225Y, V258G, N303S and N336Q | T85L, N130K, M134L, N190D, H225Y, A289P, N303S and N336Q | T85L, N130K, M134L, N190D, N229E, V258G, A289P and N303S | T85L, N130K, M134L, N190D, N229E, V258G, A289P and N336Q | T85L, N130K, M134L, N190D, N229E, V258G, N303S and N336Q |
| T85L, N130K, M134L, N190D, N229E, A289P, N303S and N336Q | T85L, N130K, M134L, N190D, V258G, A289P, N303S and N336Q | T85L, N130K, M134L, H225Y, N229E, V258G, A289P and N303S | T85L, N130K, M134L, H225Y, N229E, V258G, A289P and N336Q | T85L, N130K, M134L, H225Y, N229E, V258G, N303S and N336Q |
| T85L, N130K, M134L, H225Y, N229E, A289P, N303S and N336Q | T85L, N130K, M134L, H225Y, V258G, A289P, N303S and N336Q | T85L, N130K, M134L, N229E, V258G, A289P, N303S and N336Q | T85L, N130K, E154D, N190D, H225Y, N229E, V258G and A289P | T85L, N130K, E154D, N190D, H225Y, N229E, V258G and N303S |
| T85L, N130K, E154D, N190D, H225Y, N229E, V258G and N336Q | T85L, N130K, E154D, N190D, H225Y, N229E, A289P and N303S | T85L, N130K, E154D, N190D, H225Y, N229E, A289P and N336Q | T85L, N130K, E154D, N190D, H225Y, N229E, N303S and N336Q | T85L, N130K, E154D, N190D, H225Y, V258G, A289P and N303S |
| T85L, N130K, E154D, N190D, H225Y, V258G, A289P and N336Q | T85L, N130K, E154D, N190D, H225Y, V258G, N303S and N336Q | T85L, N130K, E154D, N190D, H225Y, A289P, N303S and N336Q | T85L, N130K, E154D, N190D, N229E, V258G, A289P and N303S | T85L, N130K, E154D, N190D, N229E, V258G, A289P and N336Q |
| T85L, N130K, E154D, N190D, N229E, V258G, N303S and N336Q | T85L, N130K, E154D, N190D, N229E, A289P, N303S and N336Q | T85L, N130K, E154D, N190D, V258G, A289P, N303S and N336Q | T85L, N130K, E154D, H225Y, N229E, V258G, A289P and N303S | T85L, N130K, E154D, H225Y, N229E, V258G, A289P and N336Q |
| T85L, N130K, E154D, H225Y, N229E, V258G, N303S and N336Q | T85L, N130K, E154D, H225Y, N229E, A289P, N303S and N336Q | T85L, N130K, E154D, H225Y, V258G, A289P, N303S and N336Q | T85L, N130K, E154D, N229E, V258G, A289P, N303S and N336Q | T85L, N130K, N190D, H225Y, N229E, V258G, A289P and N303S |
| T85L, N130K, N190D, H225Y, N229E, V258G, A289P and N336Q | T85L, N130K, N190D, H225Y, N229E, V258G, N303S and N336Q | T85L, N130K, N190D, H225Y, N229E, A289P, N303S and N336Q | T85L, N130K, N190D, H225Y, V258G, A289P, N303S and N336Q | T85L, N130K, N190D, N229E, V258G, A289P, N303S and N336Q |
| T85L, N130K, H225Y, N229E, V258G, A289P, N303S and N336Q | T85L, M134L, E154D, N190D, H225Y, N229E, V258G and A289P | T85L, M134L, E154D, N190D, H225Y, N229E, V258G and N303S | T85L, M134L, E154D, N190D, H225Y, N229E, V258G and N336Q | T85L, M134L, E154D, N190D, H225Y, N229E, A289P and N303S |
| T85L, M134L, E154D, N190D, H225Y, N229E, A289P and N336Q | T85L, M134L, E154D, N190D, H225Y, N229E, N303S and N336Q | T85L, M134L, E154D, N190D, H225Y, V258G, A289P and N303S | T85L, M134L, E154D, N190D, H225Y, V258G, A289P and N336Q | T85L, M134L, E154D, N190D, H225Y, V258G, N303S and N336Q |
| T85L, M134L, E154D, N190D, H225Y, A289P, N303S and N336Q | T85L, M134L, E154D, N190D, N229E, V258G, A289P and N303S | T85L, M134L, E154D, N190D, N229E, V258G, A289P and N336Q | T85L, M134L, E154D, N190D, N229E, V258G, N303S and N336Q | T85L, M134L, E154D, N190D, N229E, A289P, N303S and N336Q |
| T85L, M134L, E154D, N190D, V258G, A289P, N303S and N336Q | T85L, M134L, E154D, H225Y, N229E, V258G, A289P and N303S | T85L, M134L, E154D, H225Y, N229E, V258G, A289P and N336Q | T85L, M134L, E154D, H225Y, N229E, V258G, N303S and N336Q | T85L, M134L, E154D, H225Y, N229E, A289P, N303S and N336Q |
| T85L, M134L, E154D, H225Y, V258G, A289P, N303S and N336Q | T85L, M134L, E154D, N229E, V258G, A289P, N303S and N336Q | T85L, M134L, N190D, H225Y, N229E, V258G, A289P and N303S | T85L, M134L, N190D, H225Y, N229E, V258G, A289P and N336Q | T85L, M134L, N190D, H225Y, N229E, V258G, N303S and N336Q |
| T85L, M134L, N190D, H225Y, N229E, A289P, N303S and N336Q | T85L, M134L, N190D, H225Y, V258G, A289P, N303S and N336Q | T85L, M134L, N190D, N229E, V258G, A289P, N303S and N336Q | T85L, M134L, H225Y, N229E, V258G, A289P, N303S and N336Q | T85L, E154D, N190D, H225Y, N229E, V258G, A289P and N303S |
| T85L, E154D, N190D, H225Y, N229E, V258G, A289P and N336Q | T85L, E154D, N190D, H225Y, N229E, V258G, N303S and N336Q | T85L, E154D, N190D, H225Y, N229E, A289P, N303S and N336Q | T85L, E154D, N190D, H225Y, V258G, A289P, N303S and N336Q | T85L, E154D, N190D, N229E, V258G, A289P, N303S and N336Q |
| T85L, E154D, H225Y, N229E, V258G, A289P, N303S and N336Q | T85L, N190D, H225Y, N229E, V258G, A289P, N303S and N336Q | H121Y, N130K, M134L, E154D, N190D, H225Y, N229E and V258G | H121Y, N130K, M134L, E154D, N190D, H225Y, N229E and A289P | H121Y, N130K, M134L, E154D, N190D, H225Y, N229E and N303S |
| H121Y, N130K, M134L, E154D, N190D, H225Y, N229E and N336Q | H121Y, N130K, M134L, E154D, N190D, H225Y, V258G and A289P | H121Y, N130K, M134L, E154D, N190D, H225Y, V258G and N303S | H121Y, N130K, M134L, E154D, N190D, H225Y, V258G and N336Q | H121Y, N130K, M134L, E154D, N190D, H225Y, A289P and N303S |
| H121Y, N130K, M134L, E154D, N190D, H225Y, A289P and N336Q | H121Y, N130K, M134L, E154D, N190D, H225Y, N303S and N336Q | H121Y, N130K, M134L, E154D, N190D, N229E, V258G and A289P | H121Y, N130K, M134L, E154D, N190D, N229E, V258G and N303S | H121Y, N130K, M134L, E154D, N190D, N229E, V258G and N336Q |

TABLE 21-continued

Non-limiting examples of mutations [as compared to SEQ ID NO: 35]

| | | | | |
|---|---|---|---|---|
| H121Y, N130K, M134L, E154D, N190D, N229E, A289P and N303S | H121Y, N130K, M134L, E154D, N190D, N229E, A289P and N336Q | H121Y, N130K, M134L, E154D, N190D, N229E, N303S and N336Q | H121Y, N130K, M134L, E154D, N190D, V258G, A289P and N303S | H121Y, N130K, M134L, E154D, N190D, V258G, A289P and N336Q |
| H121Y, N130K, M134L, E154D, N190D, V258G, N303S and N336Q | H121Y, N130K, M134L, E154D, N190D, A289P, N303S and N336Q | H121Y, N130K, M134L, E154D, H225Y, N229E, V258G and A289P | H121Y, N130K, M134L, E154D, H225Y, N229E, V258G and N303S | H121Y, N130K, M134L, E154D, H225Y, N229E, V258G and N336Q |
| H121Y, N130K, M134L, E154D, H225Y, N229E, A289P and N303S | H121Y, N130K, M134L, E154D, H225Y, N229E, A289P and N336Q | H121Y, N130K, M134L, E154D, H225Y, N229E, N303S and N336Q | H121Y, N130K, M134L, E154D, H225Y, V258G, A289P and N303S | H121Y, N130K, M134L, E154D, H225Y, V258G, A289P and N336Q |
| H121Y, N130K, M134L, E154D, H225Y, V258G, N303S and N336Q | H121Y, N130K, M134L, E154D, H225Y, A289P, N303S and N336Q | H121Y, N130K, M134L, E154D, N229E, V258G, A289P and N303S | H121Y, N130K, M134L, E154D, N229E, V258G, A289P and N336Q | H121Y, N130K, M134L, E154D, N229E, V258G, N303S and N336Q |
| H121Y, N130K, M134L, E154D, N229E, A289P, N303S and N336Q | H121Y, N130K, M134L, E154D, V258G, A289P, N303S and N336Q | H121Y, N130K, M134L, N190D, H225Y, N229E, V258G and A289P | H121Y, N130K, M134L, N190D, H225Y, N229E, V258G and A289P | H121Y, N130K, M134L, N190D, H225Y, N229E, V258G and N336Q |
| H121Y, N130K, M134L, N190D, H225Y, N229E, A289P and N303S | H121Y, N130K, M134L, N190D, H225Y, N229E, A289P and N336Q | H121Y, N130K, M134L, N190D, H225Y, N229E, N303S and N336Q | H121Y, N130K, M134L, N190D, H225Y, V258G, A289P and N303S | H121Y, N130K, M134L, N190D, H225Y, V258G, A289P and N336Q |
| H121Y, N130K, M134L, N190D, H225Y, V258G, N303S and N336Q | H121Y, N130K, M134L, N190D, H225Y, A289P, N303S and N336Q | H121Y, N130K, M134L, N190D, N229E, V258G, A289P and N303S | H121Y, N130K, M134L, N190D, N229E, V258G, A289P and N336Q | H121Y, N130K, M134L, N190D, N229E, V258G, N303S and N336Q |
| H121Y, N130K, M134L, N190D, N229E, A289P, N303S and N336Q | H121Y, N130K, M134L, N190D, V258G, A289P, N303S and N336Q | H121Y, N130K, M134L, H225Y, N229E, V258G, A289P and N303S | H121Y, N130K, M134L, H225Y, N229E, V258G, A289P and N336Q | H121Y, N130K, M134L, H225Y, N229E, V258G, N303S and N336Q |
| H121Y, N130K, M134L, H225Y, N229E, A289P, N303S and N336Q | H121Y, N130K, M134L, H225Y, V258G, A289P, N303S and N336Q | H121Y, N130K, M134L, N229E, V258G, A289P, N303S and N336Q | H121Y, N130K, E154D, N190D, H225Y, N229E, V258G and A289P | H121Y, N130K, E154D, N190D, H225Y, N229E, V258G and N303S |
| H121Y, N130K, E154D, N190D, H225Y, N229E, V258G and N336Q | H121Y, N130K, E154D, N190D, H225Y, N229E, A289P and N303S | H121Y, N130K, E154D, N190D, H225Y, N229E, A289P and N336Q | H121Y, N130K, E154D, N190D, H225Y, N229E, N303S and N336Q | H121Y, N130K, E154D, N190D, H225Y, V258G, A289P and N303S |
| H121Y, N130K, E154D, N190D, H225Y, V258G, A289P and N336Q | H121Y, N130K, E154D, N190D, H225Y, V258G, N303S and N336Q | H121Y, N130K, E154D, N190D, H225Y, A289P, N303S and N336Q | H121Y, N130K, E154D, N190D, N229E, V258G, A289P and N303S | H121Y, N130K, E154D, N190D, N229E, V258G, A289P and N336Q |
| H121Y, N130K, E154D, N190D, N229E, V258G, N303S and N336Q | H121Y, N130K, E154D, N190D, N229E, A289P, N303S and N336Q | H121Y, N130K, E154D, N190D, V258G, A289P, N303S and N336Q | H121Y, N130K, E154D, H225Y, N229E, V258G, A289P and N303S | H121Y, N130K, E154D, H225Y, N229E, V258G, A289P and N336Q |
| H121Y, N130K, E154D, H225Y, N229E, V258G, N303S and N336Q | H121Y, N130K, E154D, H225Y, N229E, A289P, N303S and N336Q | H121Y, N130K, E154D, H225Y, V258G, A289P, N303S and N336Q | H121Y, N130K, E154D, N229E, V258G, A289P, N303S and N336Q | H121Y, N130K, N190D, H225Y, N229E, V258G, A289P and N303S |
| H121Y, N130K, N190D, H225Y, N229E, V258G, A289P and N336Q | H121Y, N130K, N190D, H225Y, N229E, V258G, N303S and N336Q | H121Y, N130K, N190D, H225Y, N229E, A289P, N303S and N336Q | H121Y, N130K, N190D, H225Y, V258G, A289P, N303S and N336Q | H121Y, N130K, N190D, N229E, V258G, A289P, N303S and N336Q |
| H121Y, N130K, H225Y, N229E, V258G, A289P, N303S and N336Q | H121Y, M134L, E154D, N190D, H225Y, N229E, V258G and A289P | H121Y, M134L, E154D, N190D, H225Y, N229E, V258G and N303S | H121Y, M134L, E154D, N190D, H225Y, N229E, V258G and N336Q | H121Y, M134L, E154D, N190D, H225Y, N229E, A289P and N303S |
| H121Y, M134L, E154D, N190D, H225Y, N229E, A289P and N336Q | H121Y, M134L, E154D, N190D, H225Y, N229E, N303S and N336Q | H121Y, M134L, E154D, N190D, H225Y, V258G, A289P and N303S | H121Y, M134L, E154D, N190D, H225Y, V258G, A289P and N336Q | H121Y, M134L, E154D, N190D, H225Y, V258G, N303S and N336Q |
| H121Y, M134L, E154D, N190D, H225Y, A289P and N336Q | H121Y, M134L, E154D, N190D, N229E, V258G, A289P and N303S | H121Y, M134L, E154D, N190D, N229E, V258G, A289P and N336Q | H121Y, M134L, E154D, N190D, N229E, V258G, N303S and N336Q | H121Y, M134L, E154D, N190D, N229E, A289P, N303S and N336Q |
| H121Y, M134L, E154D, N190D, V258G, A289P, N303S and N336Q | H121Y, M134L, E154D, H225Y, N229E, V258G, A289P and N303S | H121Y, M134L, E154D, H225Y, N229E, V258G, A289P and N336Q | H121Y, M134L, E154D, H225Y, N229E, V258G, N303S and N336Q | H121Y, M134L, E154D, H225Y, N229E, A289P, N303S and N336Q |
| H121Y, M134L, E154D, H225Y, V258G, A289P, N303S and N336Q | H121Y, M134L, E154D, N229E, V258G, A289P, N303S and N336Q | H121Y, M134L, N190D, H225Y, N229E, V258G, A289P and N303S | H121Y, M134L, N190D, H225Y, N229E, V258G, A289P and N336Q | H121Y, M134L, N190D, H225Y, N229E, V258G, N303S and N336Q |
| H121Y, M134L, N190D, H225Y, N229E, A289P, N303S and N336Q | H121Y, M134L, N190D, H225Y, V258G, A289P, N303S and N336Q | H121Y, M134L, N190D, N229E, V258G, A289P, N303S and N336Q | H121Y, M134L, H225Y, N229E, V258G, A289P, N303S and N336Q | H121Y, E154D, N190D, H225Y, N229E, V258G, A289P and N303S |
| H121Y, E154D, N190D, H225Y, N229E, V258G, A289P and N336Q | H121Y, E154D, N190D, H225Y, N229E, V258G, N303S and N336Q | H121Y, E154D, N190D, H225Y, N229E, A289P, N303S and N336Q | H121Y, E154D, N190D, H225Y, V258G, A289P, N303S and N336Q | H121Y, E154D, N190D, N229E, V258G, A289P, N303S and N336Q |
| H121Y, E154D, H225Y, N229E, V258G, A289P, N303S and N336Q | H121Y, N190D, H225Y, N229E, V258G, A289P, N303S and N336Q | N130K, M134L, E154D, N190D, H225Y, N229E, V258G and A289P | N130K, M134L, E154D, N190D, H225Y, N229E, V258G and N303S | N130K, M134L, E154D, N190D, H225Y, N229E, V258G and N336Q |
| N130K, M134L, E154D, N190D, H225Y, N229E, A289P and N303S | N130K, M134L, E154D, N190D, H225Y, N229E, A289P and N336Q | N130K, M134L, E154D, N190D, H225Y, N229E, N303S and N336Q | N130K, M134L, E154D, N190D, H225Y, V258G, A289P and N303S | N130K, M134L, E154D, N190D, H225Y, V258G, A289P and N336Q |
| N130K, M134L, E154D, N190D, H225Y, V258G, N303S and N336Q | N130K, M134L, E154D, N190D, H225Y, A289P, N303S and N336Q | N130K, M134L, E154D, N190D, N229E, V258G, A289P and N303S | N130K, M134L, E154D, N190D, N229E, V258G, A289P and N336Q | N130K, M134L, E154D, N190D, N229E, V258G, N303S and N336Q |
| N130K, M134L, E154D, N190D, N229E, A289P, N303S and N336Q | N130K, M134L, E154D, N190D, V258G, A289P, N303S and N336Q | N130K, M134L, E154D, H225Y, N229E, V258G, A289P and N303S | N130K, M134L, E154D, H225Y, N229E, V258G, A289P and N336Q | N130K, M134L, E154D, H225Y, N229E, V258G, N303S and N336Q |
| N130K, M134L, E154D, H225Y, N229E, A289P, N303S and N336Q | N130K, M134L, E154D, H225Y, V258G, A289P, N303S and N336Q | N130K, M134L, E154D, N229E, V258G, A289P, N303S and N336Q | N130K, M134L, N190D, H225Y, N229E, V258G, A289P and N303S | N130K, M134L, N190D, H225Y, N229E, V258G, A289P and N336Q |

TABLE 21-continued

Non-limiting examples of mutations [as compared to SEQ ID NO: 35]

| | | | | |
|---|---|---|---|---|
| N130K, M134L, N190D, H225Y, N229E, V258G, N303S and N336Q | N130K, M134L, N190D, H225Y, N229E, A289P, N303S and N336Q | N130K, M134L, N190D, H225Y, V258G, A289P, N303S and N336Q | N130K, M134L, N190D, N229E, V258G, A289P, N303S and N336Q | N130K, M134L, H225Y, N229E, V258G, A289P, N303S and N336Q |
| N130K, E154D, N190D, H225Y, N229E, V258G, A289P and N303S | N130K, E154D, N190D, H225Y, N229E, V258G, A289P and N336Q | N130K, E154D, N190D, H225Y, N229E, V258G, N303S and N336Q | N130K, E154D, N190D, H225Y, N229E, A289P, N303S and N336Q | N130K, E154D, N190D, H225Y, V258G, A289P, N303S and N336Q |
| N130K, E154D, N190D, N229E, V258G, A289P, N303S and N336Q | N130K, E154D, H225Y, N229E, V258G, A289P, N303S and N336Q | N130K, N190D, H225Y, N229E, V258G, A289P, N303S and N336Q | M134L, E154D, N190D, H225Y, N229E, V258G, A289P and N303S | M134L, E154D, N190D, H225Y, N229E, V258G, A289P and N336Q |
| M134L, E154D, N190D, H225Y, N229E, V258G, N303S and N336Q | M134L, E154D, N190D, H225Y, N229E, A289P, N303S and N336Q | M134L, E154D, N190D, H225Y, V258G, A289P, N303S and N336Q | M134L, E154D, N190D, N229E, V258G, A289P, N303S and N336Q | M134L, E154D, H225Y, N229E, V258G, A289P, N303S and N336Q |
| M134L, N190D, H225Y, N229E, V258G, A289P, N303S and N336Q | E154D, N190D, H225Y, N229E, V258G, A289P, N303S and N336Q | T85L, H121Y, N130K, M134L, E154D, N190D, H225Y, N229E and V258G | T85L, H121Y, N130K, M134L, E154D, N190D, H225Y, N229E and A289P | T85L, H121Y, N130K, M134L, E154D, N190D, H225Y, N229E and N303S |
| T85L, H121Y, N130K, M134L, E154D, N190D, H225Y, N229E and N336Q | T85L, H121Y, N130K, M134L, E154D, N190D, H225Y, V258G and A289P | T85L, H121Y, N130K, M134L, E154D, N190D, H225Y, V258G and N303S | T85L, H121Y, N130K, M134L, E154D, N190D, H225Y, V258G and N336Q | T85L, H121Y, N130K, M134L, E154D, N190D, H225Y, A289P and N303S |
| T85L, H121Y, N130K, M134L, E154D, N190D, H225Y, A289P and N336Q | T85L, H121Y, N130K, M134L, E154D, N190D, H225Y, N303S and N336Q | T85L, H121Y, N130K, M134L, E154D, N190D, N229E, V258G and A289P | T85L, H121Y, N130K, M134L, E154D, N190D, N229E, V258G and N303S | T85L, H121Y, N130K, M134L, E154D, N190D, N229E, V258G and N336Q |
| T85L, H121Y, N130K, M134L, E154D, N190D, N229E, A289P and N303S | T85L, H121Y, N130K, M134L, E154D, N190D, N229E, A289P and N336Q | T85L, H121Y, N130K, M134L, E154D, N190D, N229E, N303S and N336Q | T85L, H121Y, N130K, M134L, E154D, N190D, V258G, A289P and N303S | T85L, H121Y, N130K, M134L, E154D, N190D, V258G, A289P and N336Q |
| T85L, H121Y, N130K, M134L, E154D, N190D, V258G, N303S and N336Q | T85L, H121Y, N130K, M134L, E154D, N190D, A289P, N303S and N336Q | T85L, H121Y, N130K, M134L, E154D, H225Y, N229E, V258G and A289P | T85L, H121Y, N130K, M134L, E154D, H225Y, N229E, V258G and N303S | T85L, H121Y, N130K, M134L, E154D, H225Y, N229E, V258G and N336Q |
| T85L, H121Y, N130K, M134L, E154D, H225Y, N229E, A289P and N303S | T85L, H121Y, N130K, M134L, E154D, H225Y, N229E, A289P and N336Q | T85L, H121Y, N130K, M134L, E154D, H225Y, N229E, N303S and N336Q | T85L, H121Y, N130K, M134L, E154D, H225Y, V258G, A289P and N303S | T85L, H121Y, N130K, M134L, E154D, H225Y, V258G, A289P and N336Q |
| T85L, H121Y, N130K, M134L, E154D, H225Y, V258G, N303S and N336Q | T85L, H121Y, N130K, M134L, E154D, H225Y, A289P, N303S and N336Q | T85L, H121Y, N130K, M134L, E154D, N229E, V258G, A289P and N303S | T85L, H121Y, N130K, M134L, E154D, N229E, V258G, A289P and N336Q | T85L, H121Y, N130K, M134L, E154D, N229E, V258G, N303S and N336Q |
| T85L, H121Y, N130K, M134L, E154D, N229E, A289P, N303S and N336Q | T85L, H121Y, N130K, M134L, E154D, V258G, A289P, N303S and N336Q | T85L, H121Y, N130K, M134L, N190D, H225Y, N229E, V258G and A289P | T85L, H121Y, N130K, M134L, N190D, H225Y, N229E, V258G and N303S | T85L, H121Y, N130K, M134L, N190D, H225Y, N229E, V258G and N336Q |
| T85L, H121Y, N130K, M134L, N190D, H225Y, N229E, A289P and N303S | T85L, H121Y, N130K, M134L, N190D, H225Y, N229E, A289P and N336Q | T85L, H121Y, N130K, M134L, N190D, H225Y, N229E, N303S and N336Q | T85L, H121Y, N130K, M134L, N190D, H225Y, V258G, A289P and N303S | T85L, H121Y, N130K, M134L, N190D, H225Y, V258G, A289P and N336Q |
| T85L, H121Y, N130K, M134L, N190D, H225Y, V258G, N303S and N336Q | T85L, H121Y, N130K, M134L, N190D, H225Y, A289P, N303S and N336Q | T85L, H121Y, N130K, M134L, N190D, N229E, V258G, A289P and N303S | T85L, H121Y, N130K, M134L, N190D, N229E, V258G, A289P and N336Q | T85L, H121Y, N130K, M134L, N190D, N229E, V258G, N303S and N336Q |
| T85L, H121Y, N130K, M134L, N190D, N229E, A289P, N303S and N336Q | T85L, H121Y, N130K, M134L, N190D, V258G, A289P, N303S and N336Q | T85L, H121Y, N130K, M134L, H225Y, N229E, V258G, A289P and N303S | T85L, H121Y, N130K, M134L, H225Y, N229E, V258G, A289P and N336Q | T85L, H121Y, N130K, M134L, H225Y, N229E, V258G, N303S and N336Q |
| T85L, H121Y, N130K, M134L, H225Y, N229E, A289P, N303S and N336Q | T85L, H121Y, N130K, M134L, H225Y, V258G, A289P, N303S and N336Q | T85L, H121Y, N130K, M134L, N229E, V258G, A289P, N303S and N336Q | T85L, H121Y, N130K, E154D, N190D, H225Y, N229E, V258G and A289P | T85L, H121Y, N130K, E154D, N190D, H225Y, N229E, V258G and N303S |
| T85L, H121Y, N130K, E154D, N190D, H225Y, N229E, V258G and N336Q | T85L, H121Y, N130K, E154D, N190D, H225Y, N229E, A289P and N303S | T85L, H121Y, N130K, E154D, N190D, H225Y, N229E, A289P and N336Q | T85L, H121Y, N130K, E154D, N190D, H225Y, N229E, N303S and N336Q | T85L, H121Y, N130K, E154D, N190D, H225Y, V258G, A289P and N303S |
| T85L, H121Y, N130K, E154D, N190D, H225Y, V258G, A289P and N336Q | T85L, H121Y, N130K, E154D, N190D, H225Y, V258G, N303S and N336Q | T85L, H121Y, N130K, E154D, N190D, N229E, V258G, A289P and N303S | T85L, H121Y, N130K, E154D, N190D, N229E, V258G, A289P and N303S | T85L, H121Y, N130K, E154D, N190D, N229E, V258G, A289P and N336Q |
| T85L, H121Y, N130K, E154D, N190D, N229E, V258G, N303S and N336Q | T85L, H121Y, N130K, E154D, N190D, N229E, A289P, N303S and N336Q | T85L, H121Y, N130K, E154D, N190D, V258G, A289P, N303S and N336Q | T85L, H121Y, N130K, E154D, H225Y, N229E, V258G, A289P and N303S | T85L, H121Y, N130K, E154D, H225Y, N229E, V258G, A289P and N336Q |
| T85L, H121Y, N130K, E154D, H225Y, N229E, V258G, A289P, N303S and N336Q | T85L, H121Y, N130K, E154D, H225Y, N229E, A289P, N303S and N336Q | T85L, H121Y, N130K, E154D, H225Y, V258G, A289P, N303S and N336Q | T85L, H121Y, N130K, E154D, N229E, V258G, A289P, N303S and N336Q | T85L, H121Y, N130K, N190D, H225Y, N229E, V258G, A289P and N303S |
| T85L, H121Y, N130K, N190D, H225Y, N229E, | T85L, H121Y, N130K, N190D, H225Y, N229E, | T85L, H121Y, N130K, N190D, H225Y, N229E, | T85L, H121Y, N130K, N190D, H225Y, V258G, | T85L, H121Y, N130K, N190D, N229E, V258G, |

TABLE 21-continued

Non-limiting examples of mutations [as compared to SEQ ID NO: 35]

| | | | | |
|---|---|---|---|---|
| V258G, A289P and N336Q | V258G, N303S and N336Q | A289P, N303S and N336Q | A289P, N303S and N336Q | A289P, N303S and N336Q |
| T85L, H121Y, N130K, H225Y, N229E, V258G, A289P, N303S and N336Q | T85L, H121Y, M134L, E154D, N190D, H225Y, N229E, V258G and A289P | T85L, H121Y, M134L, E154D, N190D, H225Y, N229E, V258G and N303S | T85L, H121Y, M134L, E154D, N190D, H225Y, N229E, V258G and N336Q | T85L, H121Y, M134L, E154D, N190D, H225Y, N229E, A289P and N303S |
| T85L, H121Y, M134L, N190D, H225Y, N229E, A289P and N336Q | T85L, H121Y, M134L, E154D, N190D, H225Y, N229E, N303S and N336Q | T85L, H121Y, M134L, E154D, N190D, H225Y, V258G, A289P and N303S | T85L, H121Y, M134L, E154D, N190D, H225Y, V258G, A289P and N336Q | T85L, H121Y, M134L, E154D, N190D, H225Y, V258G, N303S and N336Q |
| T85L, H121Y, M134L, E154D, N190D, H225Y, A289P, N303S and N336Q | T85L, H121Y, M134L, E154D, N190D, N229E, V258G, A289P and N303S | T85L, H121Y, M134L, E154D, N190D, N229E, V258G, A289P and N336Q | T85L, H121Y, M134L, E154D, N190D, N229E, V258G, N303S and N336Q | T85L, H121Y, M134L, E154D, N190D, N229E, A289P, N303S and N336Q |
| T85L, H121Y, M134L, E154D, N190D, V258G, A289P, N303S and N336Q | T85L, H121Y, M134L, E154D, H225Y, N229E, V258G, A289P and N303S | T85L, H121Y, M134L, E154D, H225Y, N229E, V258G, A289P and N336Q | T85L, H121Y, M134L, E154D, H225Y, N229E, V258G, N303S and N336Q | T85L, H121Y, M134L, E154D, H225Y, N229E, A289P, N303S and N336Q |
| T85L, H121Y, M134L, E154D, H225Y, V258G, A289P, N303S and N336Q | T85L, H121Y, M134L, E154D, N229E, V258G, A289P, N303S and N336Q | T85L, H121Y, M134L, N190D, H225Y, N229E, V258G, A289P and N303S | T85L, H121Y, M134L, N190D, H225Y, N229E, V258G, A289P and N336Q | T85L, H121Y, M134L, N190D, H225Y, N229E, V258G, N303S and N336Q |
| T85L, H121Y, M134L, N190D, H225Y, N229E, A289P, N303S and N336Q | T85L, H121Y, M134L, N190D, H225Y, V258G, A289P, N303S and N336Q | T85L, H121Y, M134L, N190D, N229E, V258G, A289P, N303S and N336Q | T85L, H121Y, M134L, H225Y, N229E, V258G, A289P, N303S and N336Q | T85L, H121Y, E154D, N190D, H225Y, N229E, V258G, A289P and N303S |
| T85L, H121Y, E154D, N190D, H225Y, N229E, V258G, A289P and N336Q | T85L, H121Y, E154D, N190D, H225Y, N229E, V258G, N303S and N336Q | T85L, H121Y, E154D, N190D, H225Y, N229E, A289P, N303S and N336Q | T85L, H121Y, E154D, N190D, H225Y, V258G, A289P, N303S and N336Q | T85L, H121Y, E154D, N190D, N229E, V258G, A289P, N303S and N336Q |
| T85L, H121Y, E154D, H225Y, N229E, V258G, A289P, N303S and N336Q | T85L, H121Y, N190D, H225Y, N229E, V258G, A289P, N303S and N336Q | T85L, N130K, M134L, E154D, N190D, H225Y, N229E, V258G and A289P | T85L, N130K, M134L, E154D, N190D, H225Y, N229E, V258G and N303S | T85L, N130K, M134L, E154D, N190D, H225Y, N229E, V258G and N336Q |
| T85L, N130K, M134L, E154D, N190D, H225Y, N229E, A289P and N303S | T85L, N130K, M134L, E154D, N190D, H225Y, N229E, A289P and N336Q | T85L, N130K, M134L, E154D, N190D, H225Y, N229E, N303S and N336Q | T85L, N130K, M134L, E154D, N190D, H225Y, V258G, A289P and N303S | T85L, N130K, M134L, E154D, N190D, H225Y, V258G, A289P and N336Q |
| T85L, N130K, M134L, E154D, N190D, H225Y, V258G, N303S and N336Q | T85L, N130K, M134L, E154D, N190D, H225Y, A289P, N303S and N336Q | T85L, N130K, M134L, E154D, N190D, N229E, V258G, A289P and N303S | T85L, N130K, M134L, E154D, N190D, N229E, V258G, A289P and N336Q | T85L, N130K, M134L, E154D, N190D, N229E, V258G, N303S and N336Q |
| T85L, N130K, M134L, E154D, N190D, N229E, A289P, N303S and N336Q | T85L, N130K, M134L, E154D, N190D, V258G, A289P, N303S and N336Q | T85L, N130K, M134L, E154D, H225Y, N229E, V258G, A289P and N303S | T85L, N130K, M134L, E154D, H225Y, N229E, V258G, A289P and N336Q | T85L, N130K, M134L, E154D, H225Y, N229E, V258G, N303S and N336Q |
| T85L, N130K, M134L, E154D, H225Y, N229E, A289P, N303S and N336Q | T85L, N130K, M134L, E154D, N229E, V258G, A289P, N303S and N336Q | T85L, N130K, M134L, N190D, H225Y, N229E, V258G, A289P and N303S | T85L, N130K, M134L, N190D, H225Y, N229E, V258G, A289P and N336Q | T85L, N130K, M134L, N190D, H225Y, N229E, V258G, A289P and N336Q |
| T85L, N130K, M134L, N190D, H225Y, N229E, V258G, N303S and N336Q | T85L, N130K, M134L, N190D, H225Y, N229E, A289P, N303S and N336Q | T85L, N130K, M134L, N190D, H225Y, V258G, A289P, N303S and N336Q | T85L, N130K, M134L, N190D, N229E, V258G, A289P, N303S and N336Q | T85L, N130K, M134L, H225Y, N229E, V258G, A289P, N303S and N336Q |
| T85L, N130K, E154D, N190D, H225Y, N229E, V258G, A289P and N303S | T85L, N130K, E154D, N190D, H225Y, N229E, V258G, A289P and N336Q | T85L, N130K, E154D, N190D, H225Y, N229E, V258G, N303S and N336Q | T85L, N130K, E154D, N190D, H225Y, N229E, A289P, N303S and N336Q | T85L, N130K, E154D, N190D, H225Y, V258G, A289P, N303S and N336Q |
| T85L, N130K, E154D, N190D, N229E, V258G, A289P, N303S and N336Q | T85L, N130K, E154D, H225Y, N229E, V258G, A289P, N303S and N336Q | T85L, N130K, N190D, H225Y, N229E, V258G, A289P, N303S and N336Q | T85L, M134L, E154D, N190D, H225Y, N229E, V258G, A289P and N303S | T85L, M134L, E154D, N190D, H225Y, N229E, V258G, A289P and N336Q |
| T85L, M134L, E154D, N190D, H225Y, N229E, V258G, N303S and N336Q | T85L, M134L, E154D, N190D, H225Y, N229E, A289P, N303S and N336Q | T85L, M134L, E154D, N190D, H225Y, V258G, A289P, N303S and N336Q | T85L, M134L, E154D, N190D, N229E, V258G, A289P, N303S and N336Q | T85L, M134L, E154D, H225Y, N229E, V258G, A289P, N303S and N336Q |
| T85L, M134L, N190D, H225Y, N229E, V258G, A289P, N303S and N336Q | T85L, E154D, N190D, H225Y, N229E, V258G, A289P, N303S and N336Q | H121Y, N130K, M134L, E154D, N190D, H225Y, N229E, V258G and A289P | H121Y, N130K, M134L, E154D, N190D, H225Y, N229E, V258G and N303S | H121Y, N130K, M134L, E154D, N190D, H225Y, N229E, V258G and N336Q |
| H121Y, N130K, M134L, E154D, N190D, H225Y, N229E, A289P and N303S | H121Y, N130K, M134L, E154D, N190D, H225Y, N229E, A289P and N336Q | H121Y, N130K, M134L, E154D, N190D, H225Y, N229E, N303S and N336Q | H121Y, N130K, M134L, E154D, N190D, H225Y, V258G, A289P and N303S | H121Y, N130K, M134L, E154D, N190D, H225Y, V258G, A289P and N336Q |
| H121Y, N130K, M134L, E154D, N190D, H225Y, V258G, N303S and N336Q | H121Y, N130K, M134L, E154D, N190D, H225Y, A289P, N303S and N336Q | H121Y, N130K, M134L, E154D, N190D, N229E, V258G, A289P and N303S | H121Y, N130K, M134L, E154D, N190D, N229E, V258G, A289P and N336Q | H121Y, N130K, M134L, E154D, N190D, N229E, V258G, N303S and N336Q |

TABLE 21-continued

Non-limiting examples of mutations [as compared to SEQ ID NO: 35]

| | | | | |
|---|---|---|---|---|
| H121Y, N130K, M134L, E154D, N190D, N229E, A289P, N303S and N336Q | H121Y, N130K, M134L, E154D, N190D, V258G, A289P, N303S and N336Q | H121Y, N130K, M134L, E154D, H225Y, N229E, V258G, A289P and N303S | H121Y, N130K, M134L, E154D, H225Y, N229E, V258G, A289P and N336Q | H121Y, N130K, M134L, E154D, H225Y, N229E, V258G, N303S and N336Q |
| H121Y, N130K, M134L, E154D, H225Y, N229E, A289P, N303S and N336Q | H121Y, N130K, M134L, E154D, H225Y, V258G, A289P, N303S and N336Q | H121Y, N130K, M134L, E154D, N229E, V258G, A289P, N303S and N336Q | H121Y, N130K, M134L, N190D, H225Y, N229E, V258G, A289P and N303S | H121Y, N130K, M134L, N190D, H225Y, N229E, V258G, A289P and N336Q |
| H121Y, N130K, M134L, N190D, H225Y, N229E, V258G, N303S and N336Q | H121Y, N130K, M134L, N190D, H225Y, N229E, A289P, N303S and N336Q | H121Y, N130K, M134L, N190D, H225Y, V258G, A289P, N303S and N336Q | H121Y, N130K, M134L, N190D, N229E, V258G, A289P, N303S and N336Q | H121Y, N130K, M134L, H225Y, N229E, V258G, A289P, N303S and N336Q |
| H121Y, N130K, E154D, N190D, H225Y, N229E, V258G, A289P and N303S | H121Y, N130K, E154D, N190D, H225Y, N229E, V258G, A289P and N336Q | H121Y, N130K, E154D, N190D, H225Y, N229E, V258G, N303S and N336Q | H121Y, N130K, E154D, N190D, H225Y, N229E, A289P, N303S and N336Q | H121Y, N130K, E154D, N190D, H225Y, V258G, A289P, N303S and N336Q |
| H121Y, N130K, E154D, N190D, N229E, V258G, A289P, N303S and N336Q | H121Y, N130K, E154D, H225Y, N229E, V258G, A289P, N303S and N336Q | H121Y, N130K, N190D, H225Y, N229E, V258G, A289P, N303S and N336Q | H121Y, M134L, E154D, N190D, H225Y, N229E, V258G, A289P and N303S | H121Y, M134L, E154D, N190D, H225Y, N229E, V258G, A289P and N336Q |
| H121Y, M134L, E154D, N190D, H225Y, N229E, V258G, N303S and N336Q | H121Y, M134L, E154D, N190D, H225Y, N229E, A289P, N303S and N336Q | H121Y, M134L, E154D, N190D, H225Y, V258G, A289P, N303S and N336Q | H121Y, M134L, E154D, N190D, N229E, V258G, A289P, N303S and N336Q | H121Y, M134L, E154D, H225Y, N229E, V258G, A289P, N303S and N336Q |
| H121Y, M134L, N190D, H225Y, N229E, V258G, A289P, N303S and N336Q | H121Y, E154D, N190D, H225Y, N229E, V258G, A289P, N303S and N336Q | N130K, M134L, E154D, N190D, H225Y, N229E, V258G, A289P and N303S | N130K, M134L, E154D, N190D, H225Y, N229E, V258G, A289P and N336Q | N130K, M134L, E154D, N190D, H225Y, N229E, V258G, N303S and N336Q |
| N130K, M134L, E154D, N190D, H225Y, N229E, A289P, N303S and N336Q | N130K, M134L, E154D, N190D, H225Y, V258G, A289P, N303S and N336Q | N130K, M134L, E154D, N190D, N229E, V258G, A289P, N303S and N336Q | N130K, M134L, E154D, H225Y, N229E, V258G, A289P, N303S and N336Q | N130K, M134L, N190D, H225Y, N229E, V258G, A289P, N303S and N336Q |
| N130K, E154D, N190D, H225Y, N229E, V258G, A289P, N303S and N336Q | M134L, E154D, N190D, H225Y, N229E, V258G, A289P, N303S and N336Q | T85L, H121Y, N130K, M134L, E154D, N190D, H225Y, N229E, V258G and A289P | T85L, H121Y, N130K, M134L, E154D, N190D, H225Y, N229E, V258G and N303S | T85L, H121Y, N130K, M134L, E154D, N190D, H225Y, N229E, V258G and N336Q |
| T85L, H121Y, N130K, M134L, E154D, N190D, H225Y, N229E, A289P and N303S | T85L, H121Y, N130K, M134L, E154D, N190D, H225Y, N229E, A289P and N336Q | T85L, H121Y, N130K, M134L, E154D, N190D, H225Y, N229E, N303S and N336Q | T85L, H121Y, N130K, M134L, E154D, N190D, H225Y, V258G, A289P and N303S | T85L, H121Y, N130K, M134L, E154D, N190D, H225Y, V258G, A289P and N336Q |
| T85L, H121Y, N130K, M134L, E154D, N190D, H225Y, V258G, N303S and N336Q | T85L, H121Y, N130K, M134L, E154D, N190D, H225Y, A289P, N303S and N336Q | T85L, H121Y, N130K, M134L, E154D, N190D, N229E, V258G, A289P and N303S | T85L, H121Y, N130K, M134L, E154D, N190D, N229E, V258G, A289P and N336Q | T85L, H121Y, N130K, M134L, E154D, N190D, N229E, V258G, N303S and N336Q |
| T85L, H121Y, N130K, M134L, E154D, N190D, N229E, A289P, N303S and N336Q | T85L, H121Y, N130K, M134L, E154D, N190D, V258G, A289P, N303S and N336Q | T85L, H121Y, N130K, M134L, E154D, H225Y, N229E, V258G, A289P and N303S | T85L, H121Y, N130K, M134L, E154D, H225Y, N229E, V258G, A289P and N336Q | T85L, H121Y, N130K, M134L, E154D, H225Y, N229E, V258G, N303S and N336Q |
| T85L, H121Y, N130K, M134L, E154D, H225Y, N229E, A289P, N303S and N336Q | T85L, H121Y, N130K, M134L, E154D, H225Y, V258G, A289P, N303S and N336Q | T85L, H121Y, N130K, M134L, E154D, N229E, V258G, A289P, N303S and N336Q | T85L, H121Y, N130K, M134L, N190D, H225Y, N229E, V258G, A289P and N303S | T85L, H121Y, N130K, M134L, N190D, H225Y, N229E, V258G, A289P and N336Q |
| T85L, H121Y, N130K, M134L, N190D, H225Y, N229E, V258G, N303S and N336Q | T85L, H121Y, N130K, M134L, N190D, H225Y, N229E, A289P, N303S and N336Q | T85L, H121Y, N130K, M134L, N190D, H225Y, V258G, A289P, N303S and N336Q | T85L, H121Y, N130K, M134L, N190D, N229E, V258G, A289P, N303S and N336Q | T85L, H121Y, N130K, M134L, H225Y, N229E, V258G, A289P, N303S and N336Q |
| T85L, H121Y, N130K, E154D, N190D, H225Y, N229E, V258G, A289P and N303S | T85L, H121Y, N130K, E154D, N190D, H225Y, N229E, V258G, A289P and N336Q | T85L, H121Y, N130K, E154D, N190D, H225Y, N229E, V258G, N303S and N336Q | T85L, H121Y, N130K, E154D, N190D, H225Y, N229E, A289P, N303S and N336Q | T85L, H121Y, N130K, E154D, N190D, H225Y, V258G, A289P, N303S and N336Q |
| T85L, H121Y, N130K, E154D, N190D, N229E, V258G, A289P, N303S and N336Q | T85L, H121Y, N130K, E154D, H225Y, N229E, V258G, A289P, N303S and N336Q | T85L, H121Y, N130K, N190D, H225Y, N229E, V258G, A289P, N303S and N336Q | T85L, H121Y, M134L, E154D, N190D, H225Y, N229E, V258G, A289P and N303S | T85L, H121Y, M134L, E154D, N190D, H225Y, N229E, V258G, A289P and N336Q |
| T85L, H121Y, M134L, E154D, N190D, H225Y, N229E, V258G, N303S and N336Q | T85L, H121Y, M134L, E154D, N190D, H225Y, N229E, A289P, N303S and N336Q | T85L, H121Y, M134L, E154D, N190D, H225Y, V258G, A289P, N303S and N336Q | T85L, H121Y, M134L, E154D, N190D, N229E, V258G, A289P, N303S and N336Q | T85L, H121Y, M134L, E154D, H225Y, N229E, V258G, A289P, N303S and N336Q |
| T85L, H121Y, M134L, N190D, H225Y, N229E, V258G, A289P, N303S and N336Q | T85L, H121Y, E154D, N190D, H225Y, N229E, V258G, A289P, N303S and N336Q | T85L, N130K, M134L, E154D, N190D, H225Y, N229E, V258G, A289P and N303S | T85L, N130K, M134L, E154D, N190D, H225Y, N229E, V258G, A289P and N336Q | T85L, N130K, M134L, E154D, N190D, H225Y, N229E, V258G, N303S and N336Q |
| T85L, N130K, M134L, E154D, N190D, H225Y, N229E, A289P, N303S and N336Q | T85L, N130K, M134L, E154D, N190D, H225Y, V258G, A289P, N303S and N336Q | T85L, N130K, M134L, E154D, N190D, N229E, V258G, A289P, N303S and N336Q | T85L, N130K, M134L, E154D, H225Y, N229E, V258G, A289P, N303S and N336Q | T85L, N130K, M134L, N190D, H225Y, N229E, V258G, A289P, N303S and N336Q |
| T85L, N130K, E154D, N190D, H225Y, N229E, V258G, | T85L, M134L, E154D, N190D, H225Y, N229E, | H121Y, N130K, M134L, E154D, N190D, H225Y, | H121Y, N130K, M134L, E154D, N190D, H225Y, | H121Y, N130K, M134L, E154D, N190D, H225Y, |

TABLE 21-continued

Non-limiting examples of mutations [as compared to SEQ ID NO: 35]

| | | | | |
|---|---|---|---|---|
| A289P, N303S and N336Q | V258G, A289P, N303S and N336Q | N229E, V258G, A289P and N303S | N229E, V258G, A289P and N336Q | N229E, V258G, N303S and N336Q |
| H121Y, N130K, M134L, E154D, N190D, H225Y, N229E, A289P, N303S and N336Q | H121Y, N130K, M134L, E154D, N190D, H225Y, V258G, A289P, N303S and N336Q | H121Y, N130K, M134L, E154D, N190D, N229E, V258G, A289P, N303S and N336Q | H121Y, N130K, M134L, E154D, H225Y, N229E, V258G, A289P, N303S and N336Q | H121Y, N130K, M134L, N190D, H225Y, N229E, V258G, A289P, N303S and N336Q |
| H121Y, N130K, E154D, N190D, H225Y, N229E, V258G, A289P, N303S and N336Q | H121Y, M134L, E154D, N190D, H225Y, N229E, V258G, A289P, N303S and N336Q | N130K, M134L, E154D, N190D, H225Y, N229E, V258G, A289P, N303S and N336Q | T85L, H121Y, N130K, M134L, E154D, N190D, H225Y, N229E, V258G, A289P and N303S | T85L, H121Y, N130K, M134L, E154D, N190D, H225Y, N229E, V258G, A289P and N336Q |
| T85L, H121Y, N130K, M134L, E154D, N190D, H225Y, N229E, V258G, N303S and N336Q | T85L, H121Y, N130K, M134L, E154D, N190D, H225Y, N229E, A289P, N303S and N336Q | T85L, H121Y, N130K, M134L, E154D, N190D, H225Y, V258G, A289P, N303S and N336Q | T85L, H121Y, N130K, M134L, E154D, N190D, N229E, V258G, A289P, N303S and N336Q | T85L, H121Y, N130K, M134L, E154D, H225Y, N229E, V258G, A289P, N303S and N336Q |
| T85L, H121Y, N130K, M134L, N190D, H225Y, N229E, V258G, A289P, N303S and N336Q | T85L, H121Y, N130K, E154D, N190D, H225Y, N229E, V258G, A289P, N303S and N336Q | T85L, H121Y, M134L, E154D, N190D, H225Y, N229E, V258G, A289P, N303S and N336Q | T85L, N130K, M134L, E154D, N190D, H225Y, N229E, V258G, A289P, N303S and N336Q | H121Y, N130K, M134L, E154D, N190D, H225Y, N229E, V258G, A289P, N303S and N336Q |
| T85L, H121Y, N130K, M134L, E154D, N190D, H225Y, N229E, V258G, A289P, N303S and N336QA60T, Q64Y, F69L, D112E, K115E, R116N, E119K, E120K, N145D, H146S, E198R, S223N, N231T, K241Q, L251I, S273A, N274E, K278E, A303N, K314E, and S334IA60T, N61D, T63I, Q64Y, Q64K, F69L, V74K, N76G, D112E, K115E, R116N, E119K, E120K, N145D, H146S, E198R, S223N, F227L, E229N, N231T, K241Q, L251I, S273A, N274E, K278E, A303N, K314E, and S334I | A60T, N61D, T63I, Q64K, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N229E, E229N, N231T, K241Q, L251I, V258G, S273A, N274E, K278E, A289P, A303N, K314E, S334I, and N336Q | | | |

In some embodiments, the polypeptides comprise a variant protease provided for herein are 50, 60, 70, 80, 85, 90, 91 92, 93, 94, 95, 96, 97, 98, or 99% identical to the reference protease (SEQ ID NOs: 35, 55-1019, 1290-1310 and 1333; 1023-1289, 1311-1329, or 1334-1336) and comprise a mutation set herein, such as in the table above, or the groupings below. In some embodiments in addition to the mutation set of such reference sequences, the variant protease, comprises a cysteine (C) at the position in said variant sequence which corresponds to position 94 of SEQ ID NO: 35; and/or has, at the positions in said variant sequence which correspond to positions 84, 262, 284 and 286 of SEQ ID NO: 35, a lysine (K), a histidine (H), an aspartic acid (D) and/or an aspartic acid (D), respectively. In some embodiments, the polypeptide comprises a lysine (K) at position 115 as compared to SEQ ID NO: 35. In some embodiments, the polypeptide comprises or further comprises an asparagine (N) at position 130 as compared to SEQ ID NO: 35. In some embodiments, the polypeptide comprises an asparagine (N) at position 336 as compared to SEQ ID NO: 35. In some embodiments, the polypeptide comprises a glutamine (Q) at position 337 as compared to SEQ ID NO: 35. In some embodiments, the polypeptide comprises threonine (T) at position 338 as compared to SEQ ID NO: 35. In some embodiments, the polypeptide comprises an asparagine (N) at position 339 as compared to SEQ ID NO: 35. In some embodiments, the polypeptide comprises a glycine (G) at position 130 as compared to SEQ ID NO: 35. In some embodiments, the polypeptide comprises an asparagine (N) at position 284 as compared to SEQ ID NO: 35. In some embodiments, the polypeptide comprises an asparagine (N) at position 286 as compared to SEQ ID NO: 35. In some embodiments, the polypeptide comprises a lysine (K) at position 130 as compared to SEQ ID NO: 35. In some embodiments, the polypeptide comprises a glycine (G) at position 261 as compared to SEQ ID NO: 35. In some embodiments, the polypeptide comprises a glycine (G) at position 258 as compared to SEQ ID NO: 35.

In some embodiments, the polypeptide comprises any one, or any combination of K115K, N130N, N336N, Q337Q, T338T, N339N, N130G, D284N, D286N, N130K, N261G, and V258G, as compared to SEQ ID NO: 35. In some embodiments, the polypeptide comprises any one set of: K115K, N130N, N336N, Q337Q, T338T, and N339N as compared to SEQ ID NO: 35; K115K, N130G, N336N, Q337Q, T338T, and N339N as compared to SEQ ID NO: 35; D284N as compared to SEQ ID NO: 35; D286N as compared to SEQ ID NO: 35; N130K, and D284N as compared to SEQ ID NO: 35; N130K, and D286N as compared to SEQ ID NO: 35; K115K, N130N, N336N, Q337Q, T338T, N339N, and N261G as compared to SEQ ID NO: 35; K115K, N130G, N336N, Q337Q, T338T, N339N, and N261G as compared to SEQ ID NO: 35; D284N, and N261G as compared to SEQ ID NO: 35; D286N, and N261G as compared to SEQ ID NO: 35; N130K, D284N, and N261G as compared to SEQ ID NO: 35; N130K, D286N, and N261G as compared to SEQ ID NO: 35; K115K, N130N, N336N, Q337Q, T338T, N339N, and V258G as compared to SEQ ID NO: 35; K115K, N130G, N336N, Q337Q, T338T, N339N, and V258G as compared to SEQ ID NO: 35; D284N, and V258G as compared to SEQ ID NO: 35; D286N, and V258G as compared to SEQ ID NO: 35; N130K, D284N, and V258G as compared to SEQ ID NO: 35; N130K, D286N, V258G as compared to SEQ ID NO: 35; or N130K, and N261G as compared to SEQ ID NO: 35.

In some embodiments, the protease comprises a lysine (K) at position 115 as compared to SEQ ID NO: 35. In some embodiments, the protease comprises an asparagine (N) at position 130 as compared to SEQ ID NO: 35. In some embodiments, the protease comprises an asparagine (N) at position 336 as compared to SEQ ID NO: 35. In some embodiments, the protease comprises a glutamine (Q) at position 337 as compared to SEQ ID NO: 35. In some embodiments, the protease comprises threonine (T) at position 338 as compared to SEQ ID NO: 35. In some embodiments, the protease comprises an asparagine (N) at position 339 as compared to SEQ ID NO: 35. In some embodiments, the protease comprises a glycine (G) at position 130 as compared to SEQ ID NO: 35. In some embodiments, the protease comprises an asparagine (N) at position 284 as compared to SEQ ID NO: 35. In some embodiments, the protease comprises an asparagine (N) at position 286 as compared to SEQ ID NO: 35. In some embodiments, the protease comprises a lysine (K) at position 130 as compared to SEQ ID NO: 35. In some embodiments, the protease comprises a glycine (G) at position 261 as compared to SEQ ID NO: 35. In some embodiments, the protease comprises a glycine (G) at position 258 as compared to SEQ ID NO: 35.

In some embodiments, the protease comprises any one, or any combination of K115K, N130N, N336N, Q337Q, T338T, N339N, N130G, D284N, D286N, N130K, N261G, and V258G, as compared to SEQ ID NO: 35. In some embodiments, the protease comprises any one set of: K115K, N130N, N336N, Q337Q, T338T, and N339N as compared to SEQ ID NO: 35; K115K, N130G, N336N, Q337Q, T338T, and N339N as compared to SEQ ID NO: 35; D284N as compared to SEQ ID NO: 35; D286N as compared to SEQ ID NO: 35; N130K, and D284N as compared to SEQ ID NO: 35; N130K, and D286N as compared to SEQ ID NO: 35; K115K, N130N, N336N, Q337Q, T338T, N339N, and N261G as compared to SEQ ID NO: 35; K115K, N130G, N336N, Q337Q, T338T, N339N, and N261G as compared to SEQ ID NO: 35; D284N, and N261G as compared to SEQ ID NO: 35; D286N, and N261G as compared to SEQ ID NO: 35; N130K, D284N, and N261G as compared to SEQ ID NO: 35; N130K, D286N, and N261G as compared to SEQ ID NO: 35; K115K, N130N, N336N, Q337Q, T338T, N339N, and V258G as compared to SEQ ID NO: 35; K115K, N130G, N336N, Q337Q, T338T, N339N, and V258G as compared to SEQ ID NO: 35; D284N, and V258G as compared to SEQ ID NO: 35; D286N, and V258G as compared to SEQ ID NO: 35; N130K, D284N, and V258G as compared to SEQ ID NO: 35; N130K, D286N, V258G as compared to SEQ ID NO: 35; or N130K, and N261G as compared to SEQ ID NO: 35.

In some embodiments, the polypeptide comprises or further comprises a mutation at any one position, or any combination of positions, selected from 130, 131, 198, 216, 302, 119, 244, 142, 115, 241, 245, 316, 333, 139, as compared to SEQ ID NO: 35. In some embodiments, the polypeptide comprises a positively charged amino acid at position 130, as compared to SEQ ID NO: 35, optionally wherein said positively charged amino acid is arginine (R) or lysine (K). In some embodiments, the polypeptide comprises a positively charged amino acid at position 131, as compared to SEQ ID NO: 35, optionally wherein said positively charged amino acid is arginine (R) or lysine (K). In some embodiments, the polypeptide comprises a positively charged amino acid at position 130, as compared to SEQ ID NO: 35, optionally wherein said positively charged amino acid is arginine (R) or lysine (K); and wherein the polypeptide comprises a positively charged amino acid at position 131, as compared to SEQ ID NO: 35, optionally wherein said positively charged amino acid is arginine (R) or lysine (K).

In some embodiments, the polypeptide comprises any one mutation, or any set of mutations, selected from N130K, E198R, D216N, N130R, E198K, S302K, E119R, T244D, E119K, D142R, T244E, K115E, K241E, E245K, D316K, D333K, K241S, E245N, E139K. In some embodiments, the polypeptide comprises any set of mutations selected from:
N130K, E198R, and D216N; N130R, E198K, D216N, and S302K; E119R, D216N, and T244D; E119K, D142R, D216N, T244E, and S302K; K115E, D216N, K241E, E245K, D316K, and D333K; E119K, N130R, D142R, D216N, K241S, T244E, E245N, and S302K; E119K, N130R, D142R, E198K, D216N, and T244E; and K115E, N130R, E198K, D216N, K241E, E245K, and D333K.

In some embodiments, the polypeptide comprises a mutation at any one position, or any combination of positions, selected from 84, 93, 95, 97, 137, 140, 147, 150, 162, 165, 166, 171, 174, 205, 226, 237, 239, 243, 250, 251, 254, 255, 282, 288, 312, 315, 347, 349, as compared to SEQ ID NO: 1331 or 1332. In some embodiments, the polypeptide comprises a positively charged amino acid at position 138, as compared to SEQ ID NO: 1331 or 1332, optionally wherein said positively charged amino acid is arginine (R) or lysine (K). In some embodiments, the polypeptide comprises a positively charged amino acid at position 139, as compared to SEQ ID NO: 1331 or 1332, optionally wherein said positively charged amino acid is arginine (R) or lysine (K). In some embodiments, the polypeptide comprises a positively charged amino acid at position 138, as compared to SEQ ID NO: 1331 or 1332, optionally wherein said positively charged amino acid is arginine (R) or lysine (K); and wherein the polypeptide comprises a positively charged amino acid at position 139, as compared to SEQ ID NO: 1331 or 1332, optionally wherein said positively charged amino acid is arginine (R) or lysine (K).

In some embodiments, the polypeptide comprises any one mutation, or any set of mutations, selected from H84N, A93T, D95N, K97A, F137I, Q140E, A147E, D150R, N162E, R165K, D166E, N171Y, A174T, N205K, D226N, L237F, N239E, N243K, K250S, Q251E, T254E, E255K, N282D, E288K, A312K, H315K, K347Q, S349N. In some embodiments, the polypeptide comprises any set of mutations selected from: H84N, N138R, A147E, D150R, N162E, N171Y, N205K, D226N, Q251E, E255K, A312K, and S349N; A93T, D95N, Q140E, R165K, D166E, A174T, D226N, L237F, N239E, N243K, N282D, E288K, H315K, and K347Q; R70T, N72Q, and N73G; R70T, N72Q, N73G, H84N, N138R, N162E, N205K, and D226N; R70T, N72Q, N73G, N138R, and D226N; R70T, N72Q, N73G, K97A, N138R, and D226N; and R70T, N72Q, N73G, N138R, and D226N.

In some embodiments, the protease comprises a mutation at any one position, or any combination of positions, selected from 130, 131, 198, 216, 302, 119, 244, 142, 115, 241, 245, 316, 333, 139, as compared to SEQ ID NO: 35. In some embodiments, the protease comprises a positively charged amino acid at position 130, as compared to SEQ ID NO: 35, optionally wherein said positively charged amino acid is arginine (R) or lysine (K). In some embodiments, the protease comprises a positively charged amino acid at position 131, as compared to SEQ ID NO: 35, optionally wherein said positively charged amino acid is arginine (R) or lysine (K). In some embodiments, the protease comprises a positively charged amino acid at position 130, as compared to SEQ ID NO: 35, optionally wherein said positively charged amino acid is arginine (R) or lysine (K); and wherein the protease comprises a positively charged amino acid at position 131, as compared to SEQ ID NO: 35, optionally wherein said positively charged amino acid is arginine (R) or lysine (K).

In some embodiments, the protease comprises any one mutation, or any set of mutations, selected from N130K, E198R, D216N, N130R, E198K, S302K, E119R, T244D, E119K, D142R, T244E, K115E, K241E, E245K, D316K, D333K, K241S, E245N, E139K. In some embodiments, the protease comprises any set of mutations selected from: N130K, E198R, and D216N; N130R, E198K, D216N, and S302K; E119R, D216N, and T244D; E119K, D142R, D216N, T244E, and S302K; K115E, D216N, K241E, E245K, D316K, and D333K; E119K, N130R, D142R, D216N, K241S, T244E, E245N, and S302K; E119K, N130R, D142R, E198K, D216N, and T244E; and K115E, N130R, E198K, D216N, K241E, E245K, and D333K.

In some embodiments, the protease comprises a mutation at any one position, or any combination of positions, selected from 84, 93, 95, 97, 137, 140, 147, 150, 162, 165, 166, 171, 174, 205, 226, 237, 239, 243, 250, 251, 254, 255, 282, 288, 312, 315, 347, 349, as compared to SEQ ID NO: 1331 or 1332. In some embodiments, the protease comprises a positively charged amino acid at position 138, as compared to SEQ ID NO: 1331 or 1332, optionally wherein said positively charged amino acid is arginine (R) or lysine (K). In some embodiments, the protease comprises a positively charged amino acid at position 139, as compared to SEQ ID NO: 1331 or 1332, optionally wherein said positively charged amino acid is arginine (R) or lysine (K). In some embodiments, the protease comprises a positively charged amino acid at position 138, as compared to SEQ ID NO: 1331 or 1332, optionally wherein said positively charged amino acid is arginine (R) or lysine (K); and wherein the protease comprises a positively charged amino acid at position 139, as compared to SEQ ID NO: 1331 or 1332, optionally wherein said positively charged amino acid is arginine (R) or lysine (K).

In some embodiments, the protease comprises any one mutation, or any set of mutations, selected from H84N, A93T, D95N, K97A, F137I, Q140E, A147E, D150R, N162E, R165K, D166E, N171Y, A174T, N205K, D226N, L237F, N239E, N243K, K250S, Q251E, T254E, E255K, N282D, E288K, A312K, H315K, K347Q, S349N. In some embodiments, the protease comprises any set of mutations selected from: H84N, N138R, A147E, D150R, N162E, N171Y, N205K, D226N, Q251E, E255K, A312K, and S349N; A93T, D95N, Q140E, R165K, D166E, A174T, D226N, L237F, N239E, N243K, N282D, E288K, H315K, and K347Q; R70T, N72Q, and N73G; R70T, N72Q, N73G, H84N, N138R, N162E, N205K, and D226N; R70T, N72Q, N73G, N138R, and D226N; R70T, N72Q, N73G, K97A, N138R, and D226N; and R70T, N72Q, N73G, N138R, and D226N.

In some embodiments, the polypeptide comprises any mutation, or set of mutation, as provided in PCT Publication Nos. WO2016128558, and WO2016128559, or U.S. Pat. Nos. 10,696,959, 11,214,784, 10,758,597, or 11,524,057, each of which is hereby incorporated by reference in its entirety.

IdeS (Immunoglobulin G-degrading enzyme of *Streptococcus pyogenes*) is an enzyme derived from the bacterium *Streptococcus pyogenes* that cleaves IgG antibodies and has been explored for its potential therapeutic applications, particularly in the field of transplantation immunology. The immunogenicity of IdeS is a significant consideration for its clinical use, as the human immune system can potentially recognize the enzyme as a foreign protein and generate an immune response. This response could lead to the production of anti-drug antibodies (ADAs) that may neutralize the enzymatic activity of IdeS or alter its pharmacokinetics, potentially reducing its efficacy or increasing the risk of adverse effects. Furthermore, repeated administration of IdeS could enhance this immunogenic response, limiting its long-term utility in chronic conditions. Thus, for any given subject, the problems associated with the immunogenicity of IdeS are likely to present a barrier to the use of IdeS as a treatment. These problems may require increases to the dose of IdeS and/or preclude treatment with IdeS entirely, particularly if repeat administrations are required.

Existing approaches to problems of this type involve, for example, PEGylation of a therapeutic agent to reduce immunogenicity or co-administration of the therapeutic agent with an immune-suppressive agent. Some other approaches involve identification of specific positions within the sequence of IdeS which, when modified, lead to polypeptides for which the problems associated with immunogenicity are reduced as compared to IdeS. Thus, some modifications may increase the efficacy at cleaving IgG of the polypeptide of the disclosure relative to IdeS, thereby indirectly reducing immunogenicity by permitting the use of a lower dose or concentration to achieve the same effect. Alternatively, or in addition, other modifications may directly reduce immunogenicity by reducing the ability of IdeS-specific antibodies to recognise the polypeptide of the disclosure relative to IdeS.

The present disclosure provides IdeS variants that have, amongst other properties, lower immunogenicity as compared to wild-type IdeS. This can enable the variants to be administered to patients more than one time. The variants provided herein, can also comprises mutations or changes as compared to the wild-type sequence that impact post-translational modifications, aggregation, glycosylation, impurities, and formulation components), reduce B cell epitopes, thereby reducing the likelihood for creating antibody epitopes that would be produce antibodies in vivo against the variants, reduce T cell epitopes (linear peptide sequences that can be displayed on MHCII and lead to de novo immune responses), and reduce the likelihood of ADA (anti-drug antibodies). Thus, in some embodiments, a polypeptide having an IgG protease activity has one more B cell epitopes removed. In some embodiments, a polypeptide having an IgG protease activity has one or more T cell epitopes removed. In some embodiments, a polypeptide having an IgG protease activity does not have, or does not have significant, chemical liabilities. In some embodiments, a polypeptide having an IgG protease activity has one or more B cell epitopes removed, one more T cell epitopes removed, and does not have, or does not have significant, chemical liabilities. Without being bound to any particular theory, a polypeptide having an IgG protease activity, such as those provided herein, can be utilized in a way that can be administered more than once, and thus can be used in a non-dose limiting manner or method.

In some embodiments, the polypeptide having IgG protease activity is as effective, or more effective at cleaving IgG than the wild-type protease, and/or is less immunogenic as the wild-type protease. In some embodiments, the polypeptide having IgG protease activity is as effective at cleaving IgG as compared to the wild-type protease. In some embodiments, the polypeptide having IgG protease activity is more effective at cleaving IgG than the wild-type protease. In some embodiments, the polypeptide having IgG protease activity is less effective at cleaving IgG than the wild-type protease, but is also less immunogenic and/or has fewer chemical liabilities as compared to the wild-type protease. This properties can be as compared to the wild-type IdeS or the wild-type Ides that is fused to a Fc molecule, such as those provided for herein. In some embodiments, the polypeptide having IgG protease activity is less immunogenic than the wild-type protease. In some embodiments, the polypeptide having IgG protease activity is as immunogenic as the wild-type protease.

Immunogenicity can be measured by any assay, such as the one the described in Example 15. For example, immunogenicity of a variant, fused to Fc or not, can be compared to wild-type IdeS (fused to Fc or not), provided that the comparison between the variant molecule and the wild-type IdeS molecule is the same type of molecule (fused to Fc or not), by evaluating for pre-existing antibody binding the variant in human donor cells, such as PBMCs, which can be measured through an electrochemiluminescence (ECL) immunoassay. This is one exemplary method and other methods can also be used.

In some embodiments, the polypeptide having IgG protease activity is as effective, or more effective at cleaving IgG than the wild-type IdeS, and/or is less immunogenic, or as immunogenic, as the wild-type IdeS. In some embodiments, the polypeptide having IgG protease activity is as effective at cleaving IgG than the wild-type IdeS. In some embodiments, the polypeptide having IgG protease activity is more effective at cleaving IgG than the wild-type IdeS. In some embodiments, the polypeptide having IgG protease activity is less immunogenic than the wild-type IdeS. In some embodiments, the polypeptide having IgG protease activity is as immunogenic as the wild-type IdeS.

In some embodiments, PRT-1 through PRT-719 is as effective, or more effective at cleaving IgG than the wild-type protease, and/or is less immunogenic, or as immunogenic, as the wild-type protease. In some embodiments, PRT-1 through PRT-719 is as effective at cleaving IgG than the wild-type protease. In some embodiments, PRT-1 through PRT-719 is more effective at cleaving IgG than the wild-type protease. In some embodiments, PRT-1 through PRT-719 is less immunogenic than the wild-type protease. In some embodiments, PRT-1 through PRT-719 is as immunogenic as the wild-type protease.

In some embodiments, PRT-1 through PRT-719 is as effective, or more effective at cleaving IgG than the wild-type protease, and/or is less immunogenic, or as immunogenic, as the wild-type IdeS. In some embodiments, PRT-1 through PRT-719 is as effective at cleaving IgG than the wild-type IdeS. In some embodiments, PRT-1 through PRT-719 is more effective at cleaving IgG than the wild-type IdeS. In some embodiments, PRT-1 through PRT-719 is less immunogenic than the wild-type IdeS. In some embodiments, PRT-1 through PRT-719 is as immunogenic as the wild-type IdeS.

In some embodiments, VRT-1 through VRT-319 is as effective, or more effective at cleaving IgG than the wild-type protease, and/or is less immunogenic, or as immunogenic, as the wild-type protease. In some embodiments, VRT-1 through VRT-319 is as effective at cleaving IgG than the wild-type protease. In some embodiments, VRT-1 through VRT-319 is more effective at cleaving IgG than the wild-type protease. In some embodiments, VRT-1 through VRT-319 is less immunogenic than the wild-type protease. In some embodiments, VRT-1 through VRT-319 is as immunogenic as the wild-type protease.

In some embodiments, VRT-1 through VRT-319 is as effective, or more effective at cleaving IgG than the wild-type protease, and/or is less immunogenic, or as immunogenic, as the wild-type IdeS. In some embodiments, VRT-1 through VRT-319 is as effective at cleaving IgG than the wild-type IdeS. In some embodiments, VRT-1 through VRT-319 is more effective at cleaving IgG than the wild-type IdeS. In some embodiments, VRT-1 through VRT-319 is less immunogenic than the wild-type IdeS. In some embodiments, VRT-1 through VRT-319 is as immunogenic as the wild-type IdeS.

Fc Fusion Molecules

Provided herein are therapeutic compounds, e.g., therapeutic protein molecules, e.g., fusion proteins, including an effector binding/modulating moiety and a polypeptide having protease activity. Also provided are methods of using and making the therapeutic compounds. In some embodiments, the effector binding/modulating moiety is a variant Fc polypeptide, such as, but not limited to, those provided herein.

The disclosure provides for, for example, a polypeptide comprising a polypeptide having protease activity and a Fc polypeptide domain, wherein the polypeptide having protease activity is covalently or non-covalently connected to the Fc polypeptide domain. In some embodiments, the Fc polypeptide domain is a variant Fc polypeptide, such as those provided herein. Accordingly, in some embodiments, a polypeptide comprising a polypeptide having protease activity and a Fc polypeptide domain is provided, wherein the polypeptide having protease activity is covalently or non-covalently connected to the Fc polypeptide, is provided. The polypeptide having protease activity can be fused or linked (i.e., conjugated) to the Fc polypeptide. In some embodiments, the polypeptide having protease activity is non-covalently associated with the Fc polypeptide domain.

In some embodiments, the Fc polypeptide domain is an IgG Fc polypeptide, such as a Fc polypeptide that is, or derived from an IgG1, IgG2, IgG3, or IgG4 Fc polypeptide. In some embodiments, the Fc polypeptide domain is a variant Fc polypeptide domain, such as the variants provided for herein. In some embodiments, the Fc polypeptide domain is protease resistant. The Fc polypeptide can be resistant to protease to which it is connected to, thus resistant to protease cleavage and/or binding by the protease. In some embodiments, the variant Fc polypeptide, such as those provided herein, comprises a mutation that renders the IgG Fc polypeptide resistant to cleavage by a protease, or a variant thereof. In some embodiments, the variant Fc polypeptide, such as those provided herein, comprises a mutation that renders the IgG Fc polypeptide resistant to binding by a protease, or a variant thereof. In some embodiments, the variant Fc polypeptide, such as those provided herein, comprises a set of mutations that render the IgG Fc polypeptide resistant to cleavage by a protease, or a variant thereof. In some embodiments, the variant Fc polypeptide, such as those provided herein, comprises a set of mutations that render the IgG Fc polypeptide resistant to binding by a protease, or a variant thereof. In some embodiments, the variant Fc polypeptide, such as those provided herein, comprises a mutation that renders the IgG Fc polypeptide resistant to cleavage by a protease, or a variant thereof, and/or binding by a protease, or a variant thereof. In some embodiments, the variant Fc polypeptide, such as those provided herein, comprises a set of mutations that render the IgG Fc polypeptide resistant to cleavage by a protease, or a variant thereof, and/or binding by a protease, or a variant thereof. In some embodiments, the variant Fc polypeptide, such as those provided herein, is resistant to cleavage by a protease, or a variant thereof. In some embodiments, the variant Fc polypeptide, such as those provided herein, is resistant to binding by a protease, or a variant thereof. In some embodiments, the variant Fc polypeptide, such as those provided herein, is resistant to cleavage by a protease, or a variant thereof, and/or binding by a protease, or a variant thereof. It can also be resistant to other proteases that the Fc polypeptide domain is not connected to. Fc polypeptides can self-associate with one another to form a dimer. The dimer can be a homodimer where the Fc polypeptide is the same in each polypeptide molecule or can be a heterodimer where the Fc polypeptide is different in each polypeptide molecule that forms the dimer.

In some embodiments, the protease resistant Fc domain is resistant to cleavage by an IdeS protease, or variant thereof. In some embodiments, wherein the protease resistant Fc domain is completely resistant to cleavage by an IdeS protease, or a variant thereof. In some embodiments, wherein the protease resistant Fc domain is about 10%, about 20%, about 30%, about 40%, about 50%, about 60%, about 70%, about 80%, about 90%, about 91%, about 92%, about 93%, about 94%, about 95%, about 96%, about 97%, about 98%, about 99%, or about 100% resistant to cleavage by an IdeS protease, or a variant thereof. In some embodiments, wherein the protease resistant Fc domain is completely resistant to cleavage by an IdeS protease, or a variant thereof. In some embodiments, wherein the protease resistant Fc domain is 10%, 20%, 30%, 40%, 50%, 60%, 70%, 80%, 90%, 91%, 92%, 93%, 94%, 95%, 96%, 97%, 98%, 99%, or 100% resistant to cleavage by an IdeS protease, or a variant thereof. In some embodiments, the protease resistant Fc domain is resistant to cleavage by an IdeS protease, or variant thereof, as compared to the wild-type Fc domain. In some embodiments, wherein the protease resistant Fc domain is completely resistant to cleavage by an IdeS protease, or a variant thereof, as compared to the wild-type Fc domain. In some embodiments, wherein the protease resistant Fc domain is about 10%, about 20%, about 30%, about 40%, about 50%, about 60%, about 70%, about 80%, about 90%, about 91%, about 92%, about 93%, about 94%, about 95%, about 96%, about 97%, about 98%, about 99%, or about 100% resistant to cleavage by an IdeS protease, or a variant thereof, as compared to the wild-type Fc domain. In some embodiments, wherein the protease resistant Fc domain is completely resistant to cleavage by an IdeS protease, or a variant thereof. In some embodiments, wherein the protease resistant Fc domain is 10%, 20%, 30%, 40%, 50%, 60%, 70%, 80%, 90%, 91%, 92%, 93%, 94%, 95%, 96%, 97%, 98%, 99%, or 100% resistant to cleavage by an IdeS protease, or a variant thereof, as compared to the wild-type Fc domain. In some embodiments, the protease resistant Fc domain is resistant to cleavage by an IdeS protease, or variant thereof, as compared to an Fc domain that does not comprise any one or all mutations of SEQ ID NO: 23. In some embodiments, wherein the protease resistant Fc domain is completely resistant to cleavage by an IdeS protease, or a variant thereof, as compared to an Fc domain that does not comprise any one or all mutations of SEQ ID NO: 23. In some embodiments, wherein the protease resistant Fc domain is about 10%, about 20%, about 30%, about 40%, about 50%, about 60%, about 70%, about 80%, about 90%, about 91%, about 92%, about 93%, about 94%, about 95%, about 96%, about 97%, about 98%, about 99%, or about 100% resistant to cleavage by an IdeS protease, or a variant thereof, as compared to an Fc domain that does not comprise any one or all mutations of SEQ ID NO: 23. In some embodiments, wherein the protease resistant Fc domain is completely resistant to cleavage by an IdeS protease, or a variant thereof. In some embodiments, wherein the protease resistant Fc domain is 10%, 20%, 30%, 40%, 50%, 60%, 70%, 80%, 90%, 91%, 92%, 93%, 94%, 95%, 96%, 97%, 98%, 99%, or 100% resistant to cleavage by an IdeS protease, or a variant thereof, as compared to an Fc domain that does not comprise any one or all mutations of SEQ ID NO: 23.

In some embodiments, the variant Fc polypeptide is covalently or non-covalently conjugated to a polypeptide having IgG protease activity, wherein the polypeptide having IgG protease activity can be conjugated to N-terminus or C-terminus of the variant Fc polypeptide. In some embodiments, the variant Fc polypeptide is covalently or non-covalently conjugated to a polypeptide having IgG protease activity, wherein the polypeptide having IgG protease activity can be conjugated to the N-terminus of the variant Fc polypeptide. In some embodiments, the variant Fc polypeptide is covalently or non-covalently conjugated to a polypeptide having IgG protease activity, wherein the polypeptide having IgG protease activity can be conjugated to the C-terminus of the variant Fc polypeptide.

The Fc polypeptide and the polypeptide having protease activity can be physically tethered, covalently or non-covalently, directly or through a linker entity, to one another, e.g., as a domain of the same linear primary amino acid sequence in a single polypeptide. The polypeptides can associate with one another through the Fc polypeptide, such that a dimer is created having a first and second polypeptide. In some embodiments, the first polypeptide comprises a polypeptide having protease activity linked to a Fc polypeptide domain. In some embodiments, the second polypeptide comprises a Fc polypeptide domain, such as those provided for herein. In some embodiments, the second polypeptide does not comprise a protease domain. In some embodiments, the second polypeptide comprises a protease domain.

This multi-domain molecule can be referred to as a therapeutic protein molecule. In some embodiments, the protease and the IgG Fc molecule are provided in a therapeutic protein molecule, e.g., a fusion protein.

In some embodiments, polypeptide comprising the polypeptide having protease activity, the Fc polypeptide domain, which can be a variant Fc polypeptide, or both further comprises a single domain antibody molecule, e.g., a nanobody, a camelid antibody VHH molecule or human soluble VH domain. Without wishing to be bound to any particular theory, the nanobody covalently or non-covalently conjugated to the polypeptide comprising a polypeptide having a protease activity and/or an Fc polypeptide may extend the half-life of the polypeptide. In some embodiments, the single domain antibody molecule, e.g., a nanobody, a camelid antibody VHH molecule or human soluble VH domain is physically tethered, covalently or non-covalently, directly or through a linker entity, to the polypeptide having protease activity, the variant Fc polypeptide, or both. In some embodiments, the variant Fc polypeptide may also contain a single-chain fragment variable (scFv) or a Fab domain. In some embodiments, the therapeutic protein molecule, or a nucleic acid, e.g., an mRNA or DNA, encoding the therapeutic protein molecule, can be administered to a subject. In some embodiments, the polypeptide having protease activity and the variant Fc polypeptide are linked to a third entity, e.g., a carrier, e.g., a polymeric carrier, a dendrimer, or a particle, e.g., a nanoparticle. As used herein, the terms "nanobody," and "VHH" can be used interchangeably.

Non-limiting examples of nanobodies include those provided in McMahon et al., Nat Struct Mol Biol. 2018 March; 25(3): 289-296. doi:10.1038/s41594-018-0028-6; which is hereby incorporated by reference in its entirety. In some embodiments, the nanobody, or the VHH comprises an amino acid sequence as set in Table 6.

TABLE 6

| ID | VHH Seq |
|---|---|
| VHH-1 | QVQLQESGGLVQAGGSLRLSCAASGYISDAYYMGWYRQAPGKER EFVATITHGTNTYYADSVKGRFTISRDNAKNTVYLQMNSLKPED TAVYYCAVLETRSYSFRYWGQGTQVTVSSLEGGGGS (SEQ ID NO: 30) |
| VHH-2 | QVQLQESGGGLVQAGGSLRLSCAASGYISDAYYMGWYRQAPGKE REFVATITHGTNTYYADSVKGRFTISRDNAKNTVYLQMNSLKPE DTAVYYCAVLETRSYSFRYWGQGTQVTVSSLEGG (SEQ ID NO: 32) |
| VHH-3 | QVQLQESGGGLVQAGGSLRLSCAASGYISDAYYMGWYRQAPGKE REFVATITHGTNTYYADSVKGRFTISRDNAKNTVYLQMNSLKPE DTAVYYCAVLETRSYSFRYWGQGTQVTVSSLE (SEQ ID NO: 33) |

In some embodiments, a nanobody comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any sequence provided in Table 6. In some embodiments, a nanobody comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 30, 32, or 33. In some embodiments, a nanobody comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 30. In some embodiments, a nanobody comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 32. In some embodiments, a nanobody comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 33.

In some embodiments, a nanobody comprises an amino acid sequence having an amino acid sequence of SEQ ID NO: 30, 32, or 33. In some embodiments, a nanobody comprises an amino acid sequence having an amino acid sequence of SEQ ID NO: 30. In some embodiments, a nanobody comprises an amino acid sequence having an amino acid sequence of SEQ ID NO: 32. In some embodiments, a nanobody comprises an amino acid sequence having an amino acid sequence of SEQ ID NO: 33.

In some embodiments, a therapeutic compound or compound comprises a polypeptide comprising a polypeptide having protease activity covalently or non-covalently conjugated to a variant Fc polypeptide. In some embodiments, a therapeutic molecule comprises a fusion protein comprising a polypeptide having protease activity fused, e.g., directly or through a linking moiety comprising one or more amino acid residues, to a variant Fc polypeptide. In some embodiments, a therapeutic compound or compound comprises a polypeptide comprising a polypeptide having protease activity linked by a non-covalent bond or a covalent bond, e.g., a covalent bond other than a peptide bond, e.g., a sulfhydryl bond, to a variant Fc polypeptide.

In some embodiments, the protease is an IgG cleaving protease. In some embodiments, the IgG cleaving protease is selected from IdeS, IdeSsuis, IdeE, IdeZ, IdeE2, IdeZ2, Ide85, and IdeC. In some embodiments, the IgG cleaving protease is IdeS. In some embodiments, the IgG cleaving protease is IdeSsuis. In some embodiments, the IgG cleaving protease is IdeE. In some embodiments, the IgG cleaving protease is IdeZ. In some embodiments, the IgG cleaving protease is IdeE2. In some embodiments, the IgG cleaving protease is IdeZ2. In some embodiments, the IgG cleaving protease is Ide85. In some embodiments, the IgG cleaving protease is IdeC. The IgG protease can be a variant protease of any of the foregoing. Examples of IgG proteases and variant proteases include, but are not limited to, those that are described in WO2003051914, WO2006131347, WO2016128558, WO2016128559, WO2016012285, WO2008071418, WO2012119983, WO2010057626, WO2015184325, WO2021026264, WO2021021989, WO2018034346, WO2010089126, WO200908027, WO2008136735, WO2015181356, WO2018093868, WO2013037824, WO2017134274, WO2016046220, WO2015040125, WO2009033670, WO2004096157, WO2010123885, WO2010118337, WO2019075360, WO2007019376, and U.S. Pat. No. 10,836,815, each of which are hereby incorporated by reference in their entirety. Non-limiting examples of proteases include, but are not limited to proteases comprise an amino acid sequence having at least 50%, 60%, 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to, or is identical to, a sequence provided in Table 4, Table 5, Table 7, or Table 8.

In some embodiments, a polypeptide comprises a polypeptide having protease activity covalently or non-covalently conjugated to the N-terminus of a variant Fc polypeptide. In some embodiments, a polypeptide comprises a polypeptide having protease activity covalently or non-covalently conjugated to the C-terminus of a variant Fc polypeptide. In some embodiments, there can be a linker moiety, such as a peptide moiety or a non-peptide linkage, between the polypeptide having protease activity and the N-terminus or the C-terminus of the Fc polypeptide.

In some embodiments, a polypeptide comprises a polypeptide having protease activity covalently or non-covalently conjugated to a nanobody and a variant Fc polypeptide, wherein the C-terminus of the polypeptide having protease activity is covalently or non-covalently conjugated to the N-terminus of a nanobody, and the N-terminus of the polypeptide having protease activity is covalently or non-covalently conjugated to the C-terminus of a variant Fc polypeptide. In some embodiments, a polypeptide comprises a polypeptide having protease activity covalently or non-covalently conjugated to a nanobody and a variant Fc polypeptide, wherein the N-terminus of a polypeptide having protease activity is covalently or non-covalently conjugated to the C-terminus of a nanobody, and the C-terminus of the polypeptide having protease activity is covalently or non-covalently conjugated to the N-terminus of a variant Fc polypeptide. In some embodiments, the polypeptide having protease activity is as provided herein. In some embodiments, the variant IgG Fc is as provided herein. In some embodiments, the nanobody is as provided herein.

In some embodiments, a polypeptide comprising a polypeptide having protease activity covalently or non-covalently conjugated to a variant Fc polypeptide further comprises a tag, such as a purification tag or detection tag. The tag can be used to facilitate the purification, isolation, or detection of the polypeptide. A non-limiting example of such a tag is a histidine tag, which is a plurality of histidines (e.g., 6 or more histidines). In some embodiments, a polypeptide comprising a polypeptide having protease activity covalently or non-covalently conjugated to a variant Fc polypeptide further comprises a histidine tag, wherein the C-terminus of the polypeptide having protease activity is covalently or non-covalently conjugated to the N-terminus of a variant Fc polypeptide, and wherein the C-terminus of the variant Fc polypeptide is covalently or non-covalently conjugated to the N-terminus of the tag. In some embodiments, a polypeptide comprising a polypeptide having protease activity covalently or non-covalently conjugated to a nanobody and a variant Fc polypeptide further comprises a tag. In some embodiments, a polypeptide comprising a polypeptide having protease activity covalently or non-covalently conjugated to a nanobody and a variant Fc polypeptide further comprises a tag, wherein the N-terminus of the polypeptide having protease activity is covalently or non-covalently conjugated to the C-terminus of the nanobody, wherein the C-terminus of the polypeptide having protease activity is covalently or non-covalently conjugated to the N-terminus of a variant Fc polypeptide, and wherein the C-terminus of the variant Fc polypeptide is covalently or non-covalently conjugated to the N-terminus of the tag. In some embodiments, a polypeptide comprising a polypeptide having protease activity covalently or non-covalently conjugated to a nanobody and a variant Fc polypeptide further comprises a histidine tag, wherein the N-terminus of the polypeptide having protease activity is covalently or non-covalently conjugated to the C-terminus of a variant Fc polypeptide, wherein the C-terminus of the polypeptide having protease activity is covalently or non-covalently conjugated to the N-terminus of the nanobody, and wherein the C-terminus of the nanobody is covalently or non-covalently conjugated to the N-terminus of the tag.

In some embodiments, the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to a sequence provided in Table 3. In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical to SEQ ID NO: 19, 20, 21, 22, 23, 24, 25, 42, 43, 44, 45, 46, 47, 48, or 49. In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to, or is identical to, SEQ ID NO: 23.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to a sequence provided in Table 3, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to a sequence provided in Table 3, and further comprises one or more mutations at position L234, L235, G237, Y296, P329, or any combination thereof.

As used herein, the positions referenced in the Fc polypeptides as positions for a mutation refer to EU numbering system. The Fc polypeptides can aligned with a wild-type sequence to determine the positions that are mutated according to the numbering system.

As used herein in reference to a polypeptide that has a % identity to a reference sequence and further comprises a mutation at one or more positions, means a polypeptide that has the recited % identity to the reference sequence and also has one or more of the mutations at the recited positions.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position L234, L235, G237, Y296, P329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position L234, L235, G237, Y296, P329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations of L234A, L235A, G237A, Y296Q, P329K, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations of L234A, L235A, G237A, Y296Q, P329K, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations of L234A, L235A, G237A, Y296Q, P329K, or any combination thereof.

In some embodiments, a polypeptide comprises a polypeptide having protease activity covalently or non-covalently conjugated to a variant Fc polypeptide, wherein the variant Fc polypeptide comprises an amino acid sequence as provided in Table 3.

In some embodiments, a polypeptide comprises a polypeptide having protease activity covalently or non-covalently conjugated to a variant Fc polypeptide, wherein the variant Fc polypeptide comprises an amino acid sequence of SEQ ID NO: 19, 20, 21, 22, 23, 24, 25, 42, 43, 44, 45, 47, 48, or 49. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 19. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 20. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 21. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 22. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 23. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 24. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 25. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 42. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 43. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 44. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 45. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 47. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 48. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 49.

In some embodiments, a polypeptide comprises a polypeptide having protease activity covalently or non-covalently conjugated to a variant Fc polypeptide, wherein the variant Fc polypeptide comprises an amino acid sequence having a C-terminal lysine (K). In some embodiments, a polypeptide comprises a polypeptide having protease activity covalently or non-covalently conjugated to a variant Fc polypeptide, wherein the variant Fc polypeptide comprises an amino acid sequence that does not have (comprise) a C-terminal lysine (K).

In some embodiments, the protease present in the polypeptides provided for herein comprise an amino acid sequence having at least 50%, at least 60%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to, or is identical to, a sequence provided in Table 4, Table 5, Table 7, or Table 8, wherein the protease is covalently or non-covalently conjugated to a variant Fc polypeptide, and wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, and wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, 25, 42, 43, 44, 45, 47, 48, or 49.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, and the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position 234, 235, 237, 296, 329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations at position L234, L235, G237, Y296, P329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position L234, L235, G237, Y296, P329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position L234, L235, G237, Y296, P329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 4, Table 5, Table 7, or Table 8, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations at position 234, 235, 237, 296, 329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position 234, 235, 237, 296, 329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position 234, 235, 237, 296, 329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 4, Table 5, Table 7, or Table 8, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations at position L234, L235, G237, Y296, P329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations at position L234, L235, G237, Y296, P329, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations at position L234, L235, G237, Y296, P329, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations of L234A, L235A, G237A, Y296Q, P329K, or any combination thereof.

In some embodiments, a polypeptide comprises a polypeptide having protease activity covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations of L234A, L235A, G237A, Y296Q, P329K, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 4, Table 5, Table 7, or Table 8, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 3, and further comprises one or more mutations of L234A, L235A, G237A, Y296Q, P329K, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations of L234A, L235A, G237A, Y296Q, P329K, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, or 25, and further comprises one or more mutations of L234A, L235A, G237A, Y296Q, P329K, or any combination thereof.

In some embodiments, a polypeptide comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23, and further comprises one or more mutations of L234A, L235A, G237A, Y296Q, P329K, or any combination thereof.

In some embodiments, a polypeptide comprises a polypeptide having protease activity covalently or non-covalently conjugated to a variant Fc polypeptide, wherein the variant Fc polypeptide comprises an amino acid sequence as provided in Table 3. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 19, 20, 21, 22, 23, 24, 25, 42, 43, 44, 45, 46, 47, 48, or 49. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 19. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 20. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 21. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 22. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 23. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 24. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 25. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 42. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 43. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 44. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 45. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 46. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 47. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 48. In some embodiments, a polypeptide comprises a polypeptide having protease activity covalently or non-covalently conjugated to a variant Fc polypeptide, wherein the variant Fc polypeptide comprises an amino acid sequence of SEQ ID NO: 49.

In some embodiments, a polypeptide comprises a polypeptide having protease activity comprising any sequence provided in Table 4, Table 5, Table 7, or Table 8, wherein the polypeptide having protease activity is covalently or non-covalently conjugated to a variant Fc polypeptide, wherein the variant Fc polypeptide comprises an amino acid sequence as provided in Table 3. In some embodiments, a polypeptide comprises a polypeptide having protease activity comprising an amino acid sequence of SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence of SEQ ID NO: 19, 20, 21, 22, 23, 24, 25, 42, 43, 44, 45, 46, 47, 48, or 49.

In some embodiments, a polypeptide comprises a polypeptide having protease activity comprising an amino acid sequence of SEQ ID NO: 26, 28, 29, 31, 36, 37, 38, 39, 40, 41, 50, 51, 52, 55-1019, 1290-1310, or 1333, wherein the polypeptide having protease activity is covalently or non-covalently conjugated to a variant Fc polypeptide, wherein the variant Fc polypeptide comprises an amino acid sequence of SEQ ID NO: 23.

In some embodiments, a polypeptide comprises a polypeptide having protease activity covalently or non-covalently conjugated to a variant Fc polypeptide, wherein the variant Fc polypeptide comprises an amino acid sequence having a C-terminal lysine (K).

In some embodiments, a polypeptide comprises a polypeptide having protease activity covalently or non-covalently conjugated to a variant Fc polypeptide, wherein the variant Fc polypeptide comprises an amino acid sequence not having a C-terminal lysine (K).

In some embodiments, a histidine tag comprises an amino acid sequence of SEQ ID NO: 27, or 34. In some embodiments, the histidine tag comprises an amino acid sequence of SEQ ID NO: 27. In some embodiments, the histidine tag comprises an amino acid sequence of SEQ ID NO: 34.

In some embodiments, a polypeptide has the formula from N-terminus to C-terminus:

P1---variant Fc, wherein,
P1 comprises a polypeptide having protease activity; and
variant Fc is any variant IgG Fc provided herein.

In some embodiments, a polypeptide has the formula from N-terminus to C-terminus:

variant Fc---P1, wherein,
P1 comprises a polypeptide having protease activity; and
variant Fc is any variant IgG Fc provided herein.

In some embodiments, a polypeptide has the formula from N-terminus to C-terminus:

P1---variant Fc, wherein,
P1 comprises a polypeptide having protease activity;
variant Fc is any variant IgG Fc provided herein; and
optionally wherein the protease is a glycosylation-resistant protease.

In some embodiments, a polypeptide has the formula from N-terminus to C-terminus:

variant Fc---P1, wherein,
P1 comprises a polypeptide having protease activity;
variant Fc is any variant IgG Fc provided herein; and
optionally wherein the protease is a glycosylation-resistant protease.

In some embodiments, a polypeptide has the formula from N-terminus to C-terminus:

N1---P1---variant Fc, wherein,
P1 comprises a polypeptide having protease activity;
N1 comprises a nanobody; and
variant Fc is any variant IgG Fc provided herein.

In some embodiments, a polypeptide has the formula from N-terminus to C-terminus:

variant Fc---P1---N1, wherein,
P1 comprises a polypeptide having protease activity;
N1 comprises a nanobody; and
variant Fc is any variant IgG Fc provided herein.

In some embodiments, a polypeptide has the formula from N-terminus to C-terminus:

N1---variant Fc---P1, wherein,
P1 comprises a polypeptide having protease activity;
N1 comprises a nanobody; and
variant Fc is any variant IgG Fc provided herein.

In some embodiments, a polypeptide has the formula from N-terminus to C-terminus:

P1---variant Fc---N1, wherein,
P1 comprises a polypeptide having protease activity;
N1 comprises a nanobody; and
variant Fc is any variant IgG Fc provided herein.

In some embodiments, a polypeptide has the formula from N-terminus to C-terminus:

P1---N1, wherein,
P1 comprises a polypeptide having protease activity; and
N1 comprises a nanobody.

In some embodiments, a polypeptide has the formula from N-terminus to C-terminus:

N1---P1, wherein,
P1 comprises a polypeptide having protease activity; and
N1 comprises a nanobody.

In some embodiments, a polypeptide has the formula from N-terminus to C-terminus:

N1---P1---variant Fc, wherein,
P1 comprises a polypeptide having protease activity;
N1 comprises a nanobody; and
variant Fc is any variant IgG Fc provided herein; and
optionally wherein the protease is a glycosylation-resistant protease.

In some embodiments, a polypeptide has the formula from N-terminus to C-terminus:

variant Fc---P1---N1, wherein,
P1 comprises a polypeptide having protease activity;
N1 comprises a nanobody; and
variant Fc is any variant IgG Fc provided herein; and
optionally wherein the protease is a glycosylation-resistant protease.

In some embodiments, a polypeptide has the formula from N-terminus to C-terminus:

N1---variant Fc---P1, wherein,
P1 comprises a polypeptide having protease activity;
N1 comprises a nanobody; and
variant Fc is any variant IgG Fc provided herein; and
optionally wherein the protease is a glycosylation-resistant protease.

In some embodiments, a polypeptide has the formula from N-terminus to C-terminus:

P1---variant Fc---N1, wherein,
P1 comprises a polypeptide having protease activity;
N1 comprises a nanobody; and
variant Fc is any variant IgG Fc provided herein; and
optionally wherein the protease is a glycosylation-resistant protease.

In some embodiments, a polypeptide has the formula from N-terminus to C-terminus:

P1---N1, wherein,
P1 comprises a polypeptide having protease activity; and
N1 comprises a nanobody; and
optionally wherein the protease is a glycosylation-resistant protease.

In some embodiments, a polypeptide has the formula from N-terminus to C-terminus:

N1---P1, wherein,
P1 comprises a polypeptide having protease activity; and
N1 comprises a nanobody; and
optionally wherein the protease is a glycosylation-resistant protease.

In some embodiments, P1, and variant Fc are covalently or non-covalently conjugated to each other, as according to the above formulas. In some embodiments, P1, N1, and variant Fc are covalently or non-covalently conjugated to each other, as according to the above formulas.

In some embodiments, P1 comprises a polypeptide having protease activity. In some embodiments, N1 comprises a nanobody. In some embodiments, P1 comprises a polypeptide having protease activity, and N1 comprises a nanobody.

In some embodiments, P1 comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any sequence provided in Table 4, Table 5, Table 7, or Table 8. In some embodiments, P1 comprises a polypeptide having protease activity comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333.

In some embodiments, P1 comprises a polypeptide having protease activity comprising any sequence provided in Table 4, Table 5, Table 7, or Table 8. In some embodiments, P1 comprises a polypeptide having protease activity comprising an amino acid sequence of SEQ ID NO: 26, 28, 29, 31, 36, 37, 38, 39, 40, 41, 50, 51, 52, 55-1019, 1290-1310, or 1333.

In some embodiments, P1 comprises an IdeS, IdeSsuis, IdeE, IdeZ, IdeZ2, IdeE2, Ide85, or IdeC protease. In some embodiments, P1 comprises an IdeS, IdeSsuis, IdeE, IdeZ, IdeZ2, IdeE2, Ide85, or IdeC protease variant. In some embodiments, P1 comprises an IdeS, IdeSsuis, IdeE, IdeZ, IdeZ2, IdeE2, Ide85, or IdeC protease variant comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 26, 28, 29, 31, 36, 37, 38, 39, 40, 41, 50, 51, 52, 55-1019, 1290-1310, or 1333.

In some embodiments, P1 comprises an IdeS, IdeSsuis, IdeE, IdeZ, IdeZ2, IdeE2, Ide85, or IdeC protease variant comprising an amino acid sequence of SEQ ID NO: 26, 28, 29, 31, 36, 37, 38, 39, 40, 41, 50, 51, 52, 55-1019, 1290-1310, or 1333.

In some embodiments, the variant Fc comprises a variant Fc polypeptide. In some embodiments, the variant Fc polypeptide is such as those provided herein. In some embodiments, the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 19, 20, 21, 22, 23, 24, 25, 42, 43, 44, 45, 47, 48, or 49. In some embodiments, the variant Fc polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 23.

In some embodiments, the variant Fc polypeptide comprises an amino acid sequence of SEQ ID NO: 19, 20, 21, 22, 23, 24, 25, 42, 43, 44, 45, 47, 48, or 49. In some embodiments, the variant Fc polypeptide comprises an amino acid sequence of SEQ ID NO: 19. In some embodiments, the variant Fc polypeptide comprises an amino acid sequence of SEQ ID NO: 20. In some embodiments, the variant Fc polypeptide comprises an amino acid sequence of SEQ ID NO: 21. In some embodiments, the variant Fc polypeptide comprises an amino acid sequence of SEQ ID NO: 22. In some embodiments, the variant Fc polypeptide comprises an amino acid sequence of SEQ ID NO: 23. In some embodiments, the variant Fc polypeptide comprises an amino acid sequence of SEQ ID NO: 24. In some embodiments, the variant Fc polypeptide comprises an amino acid sequence of SEQ ID NO: 25. In some embodiments, the variant Fc polypeptide comprises an amino acid sequence of SEQ ID NO: 42. In some embodiments, the variant Fc polypeptide comprises an amino acid sequence of SEQ ID NO: 43. In some embodiments, the variant Fc polypeptide comprises an amino acid sequence of SEQ ID NO: 44. In some embodiments, the variant Fc polypeptide comprises an amino acid sequence of SEQ ID NO: 45. In some embodiments, the variant Fc polypeptide comprises an amino acid sequence of SEQ ID NO: 46. In some embodiments, the variant Fc polypeptide comprises an amino acid sequence of SEQ ID NO: 47. In some embodiments, the variant Fc polypeptide comprises an amino acid sequence of SEQ ID NO: 48. In some embodiments, the variant Fc polypeptide comprises an amino acid sequence of SEQ ID NO: 49.

In some embodiments, N1 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 30, 32, or 33. In some embodiments, N1 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 30. In some embodiments, N1 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 32. In some embodiments, N1 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 33.

In some embodiments, N1 comprises a nanobody comprising an amino acid sequence of SEQ ID NO: 30, 32, or 33. In some embodiments, N1 comprises a nanobody comprising an amino acid sequence of SEQ ID NO: 30. In some embodiments, N1 comprises a nanobody comprising an amino acid sequence of SEQ ID NO: 32. In some embodiments, N1 comprises a nanobody comprising an amino acid sequence of SEQ ID NO: 33.

In some embodiments, R4 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to SEQ ID NO: 30, 32, or 33. In some embodiments, R4 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 30. In some embodiments, R4 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 32. In some embodiments, R4 comprises a nanobody comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to SEQ ID NO: 33.

In some embodiments, R4 comprises a nanobody comprising an amino acid sequence of SEQ ID NO: 30, 32, or 33. In some embodiments, R4 comprises a nanobody comprising an amino acid sequence of SEQ ID NO: 30. In some embodiments, R4 comprises a nanobody comprising an amino acid sequence of SEQ ID NO: 32. In some embodiments, R4 comprises a nanobody comprising an amino acid sequence of SEQ ID NO: 33.

In some embodiments, a polypeptide having the formula from N-terminus to C-terminus:

N1---P1---variant Fc---R2---R4, further comprises a histidine tag (His-tag), wherein the His-tag is covalently or non-covalently conjugated to the C-terminus of the polypeptide. In some embodiments, the His-tag is such as those provided herein. In some embodiments, the His-tag comprises the sequence of HHHHHH (SEQ ID NO: 34), or HHHHHHHH (SEQ ID NO: 27).

In some embodiments, a molecule comprises: a) a dimer Fc molecule comprising: a first Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1(WT), provided that the Fc polypeptide comprises a mutation, or a set of mutations at any one position, or any combination of positions selected from 234, 235, 237, 296, and 329 as compared to SEQ ID NO: 1; and a second Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1(WT), provided that the Fc polypeptide comprises a mutation, or a set of mutations at any one position, or any combination of positions selected from 234, 235, 237, 296, and 329 as compared to SEQ ID NO: 1, wherein the first Fc polypeptide and the second Fc polypeptide associate with each other to form the dimer Fc molecule; and b) a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 35, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35, wherein the polypeptide is linked or conjugated to N- or C-terminus of the first Fc polypeptide and/or the second Fc polypeptide.

In some embodiments, the Fc dimer molecule is a homodimer. In some embodiments, the Fc dimer molecule is a heterodimer. In some embodiments, the first Fc polypeptide comprises the set of mutations at positions 234, 235, 237, 296, and 329 as compared to SEQ ID NO: 1.

In some embodiments, the second Fc polypeptide comprises the set of mutations at positions 234, 235, 237, 296, and 329 as compared to SEQ ID NO: 1.

In some embodiments, the first Fc polypeptide comprises the set of mutations at positions 234, 235, 237, 296, and 329 as compared to SEQ ID NO: 1; and the second Fc polypeptide comprises the set of mutations at positions 234, 235, 237, 296, and 329 as compared to SEQ ID NO: 1.

In some embodiments, a molecule comprises: a) a dimer Fc molecule comprising: a first Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1; and a second Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1, wherein the first Fc polypeptide and the second Fc polypeptide associate with each other to form the dimer Fc molecule; and b) a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336, as compared to SEQ ID NO: 35, wherein the polypeptide is linked or conjugated to N- or C-terminus of the first Fc polypeptide and/or the second Fc polypeptide.

In some embodiments, a molecule comprises a dimer Fc molecule comprising a first Fc polypeptide having an amino acid sequence of SEQ ID NO: 23, and a second Fc polypeptide having an amino acid sequence of SEQ ID NO: 23, wherein the first Fc polypeptide and the second Fc polypeptide associate with each other to form the dimer Fc molecule; and a polypeptide having an amino acid sequence of any one, or any combination of SEQ ID NOs: 1290, 1295, 1301, 1303, and 1310, wherein the polypeptide is linked or conjugated to N- or C-terminus of the first Fc polypeptide and/or the second Fc polypeptide.

In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1290, wherein the polypeptide is linked or conjugated to N- or C-terminus of the first Fc polypeptide and/or the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1295, wherein the polypeptide is linked or conjugated to N- or C-terminus of the first Fc polypeptide and/or the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1301, wherein the polypeptide is linked or conjugated to N- or C-terminus of the first Fc polypeptide and/or the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1303, wherein the polypeptide is linked or conjugated to N- or C-terminus of the first Fc polypeptide and/or the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1310, wherein the polypeptide is linked or conjugated to N- or C-terminus of the first Fc polypeptide and/or the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1295, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1295 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1301, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1301 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1303, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1303 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1310, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1310 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1290, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1290 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1301, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1301 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1303, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1303 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1310 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1290, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1290 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1295, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1295 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1303, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1303 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1310 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1290, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1290 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1295, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1295 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1301, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1301 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1310, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1310 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1290 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1295, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1295 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1301, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1301 is linked or conjugated to N- or C-terminus of the second Fc polypeptide. In some embodiments, the molecule comprises the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1303, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1303 is linked or conjugated to N- or C-terminus of the second Fc polypeptide.

In some embodiments, a polypeptide comprises an amino acid sequence, and N-terminus to C-terminus orientation, as provided in Table 7, Table 8, Table 9, Table 10, Table 11, Table 12, and Table 13. In some embodiments, the polypeptide comprises a protease moiety, wherein the protease moiety is a polypeptide having protease activity, such as those provided herein. In some embodiments, the polypeptide comprises an Fc moiety, wherein the Fc moiety is a Fc variant such as those provided herein.

TABLE 7

| ID | N-terminus Protease Moiety | C-terminus Fc Moiety | Full length Sequence |
|---|---|---|---|
| VRT-1 | VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 753) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 1023) |
| VRT-2 | VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 754) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | VTSVWTKGVTPPAKFTQGEDVFHAPYVANQGWYDITKTFNGKDDLLCGAATAGNMLHWWFDQNKEIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 1024) |
| VRT-3 | QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS (SEQ ID NO: 755) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 1025) |
| VRT-4 | SQTEDSESLQRLRDIEDFQAEKKMQNVVYTKWLDGVDVKDHDFR | DKTHTCPPCPAPEAAGAPSVFLFPPKPKDTLM | SQTEDSESLQRLRDIEDFQAEKKMQNVVYTKWLDGVDVKDHDFRKIVDGNIAYYATPLLNGRGFYDINKDFNRDSD |

TABLE 7-continued

| ID | N-terminus Protease Moiety | C-terminus Fc Moiety | Full length Sequence |
|---|---|---|---|
| | KIVDGNIAYYATPLLNGRGFYD INKDFNRDSDKCAAAVAANMFH YWLDINRDNVDRFLRQNPEKHG IIELPDGQLKLSDFLNTYESDH GYRDKSKLFDFISNNFNGPVWT DKLLDNYINGYAYNYKYGRTIE DPTKNTSKINFFKEVFNEKILT NNHSIRNQEFSVLLSEALYTG KAIGLSYGPAGLRHSLGHIISV WGADLDADGNVVAIYVTDSDDK KLTIGDERVGLKRYKISTDDEN RLRLTAYEETHNTGGQIRGLWT LDTGKYAWADYFDKTEQTGTDQ AEQ (SEQ ID NO: 756) | ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | KCAAAVAANMFHYWLDINRDNVDRFLRQNPEKHGIIEL PDGQLKLSDFLNTYESDHGYRDKSKLFDFISNNFNGPV WTDKLLDNYINGYAYNYKYGRTIEDPTKNTSKINFFKE VFNEKILTNNHSIRNQEFSVLLSEALYTGKAIGLSYG PAGLRHSLGHIISVWGADLDADGNVVAIYVTDSDDKKL TIGDERVGLKRYKISTDDENRLRLTAYEETHNTGGQIR GLWTLDTGKYAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1026) |
| VRT-5 | VTSVWTKGVTPPANFTQGEDVF HAPYKANQGWYDITKTFNGKDD LLCGAATAGNMLHWWFDQNKDQ IEAYLKEHPEKQKINFNGEQMF DVKEAIDTKDDQTNSKLFEYFK EKAFPYLSTKHLGVFPDHVLDM FINGYRLSLTNHGPTPVKEGS KDPRGGIFDAVFTRGDQSKLLTS RHDFKEKTLKEISDLIKQELTE GKALALSHTYANVRINHVINLW GADFDSNGNLEAIYVTDSDSNA SIGMKKYFVGVNSAGKVAISAK EIEDDNIGAQVLGLFTLSTGQD IWNQTN (SEQ ID NO: 757) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYKANQGWYDITKT FNGKDDLLCGAATAGNMLHWWFDQNKDQIEAYLKEHPE KQKINFNGEQMFDVKEAIDTKDDQTNSKLFEYFKEKAF PYLSTKHLGVFPDHVLDMFINGYRLSLTNHGPTPVKEG SKDPRGGIFDAVFTRGDQSKLLTSRHDFKEKTLKEISD LIKQELTEGKALALSHTYANVRINHVINLWGADFDSNG NLEAIYVTDSDSNASIGMKKYFVGVNSAGKVAISAKEI EDDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1027) |
| VRT-6 | VTSVWTKGVTPPANFTQGEDVF HAPYVANQGWYDITKTFNGKDD LLCGAATAGNMLHWWFDQNKDQ IERYLKEHPEKQKINFNGEQMF DVKEAIDTKDSQTDSKLFEYFK EKAFPYLSTKHLGVFPDHVLDM FINGYRLSLTNHGPTPVKEGS KDPRGGIFDAVFTRGDQSKLLTS RHDFKEKTLKEISDLIKQELTE GKALGLSHTYANVRINHVINLW GADFDSEGNLKAIYVTDSDSNA SIGMKKYFVGVNSAGKVAISAK EIKEDNIGAQVLGLFTLSTGQD IWNQTN (SEQ ID NO: 758) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYVANQGWYDITKT FNGKDDLLCGAATAGNMLHWWFDQNKDQIERYLKEHPE KQKINFNGEQMFDVKEAIDTKDSQTDSKLFEYFKEKAF PYLSTKHLGVFPDHVLDMFINGYRLSLTNHGPTPVKEG SKDPRGGIFDAVFTRGDQSKLLTSRHDFKEKTLKEISD LIKQELTEGKALGLSHTYANVRINHVINLWGADFDSEG NLKAIYVTDSDSNASIGMKKYFVGVNSAGKVAISAKEI KEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1028) |
| VRT-7 | VTSVWTKGVTPPTNFTYGEDVL HAPYVANQGWYDITKTFNGKDD LLCGAATAGNMLHWWFDQNKEQ IENYLKKHPEKQKINFNGEQMF DVKEAIDTKDSQLDSKLFEYFK EKAFPYLSTKHLGVFPDHVIDM FINGYRLSLTNHGPTPVKRGSK KDPRGGIFDAVFTRGDQSKLLTN RHDFKEKTLKEISDLIKQELTE GKALGISHTYANVRINHVINLW GADFDAEGNLEAIYVTDSDSNA SIGMKKYFVGVNSNGKVAISAK EIEEDNIGAQVLGLFTLSTGQD IWNQTN (SEQ ID NO: 759) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTNFTYGEDVLHAPYVANQGWYDITKT FNGKDDLLCGAATAGNMLHWWFDQNKEQIENYLKKHPE KQKINFNGEQMFDVKEAIDTKDSQLDSKLFEYFKEKAF PYLSTKHLGVFPDHVIDMFINGYRLSLTNHGPTPVKRG SKDPRGGIFDAVFTRGDQSKLLTNRHDFKEKTLKEISD LIKQELTEGKALGISHTYANVRINHVINLWGADFDAEG NLEAIYVTDSDSNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1029) |
| VRT-8 | VTSVWTKGVTPPADFTQGEDVF HAPYVANQGWYDITKTFNGKDD LLCGAATAGNMLHWWFDQNKEY IEAYLKKHPEKQKIMFGDQELL DVRKAINTKGSQKNSELFNYFR DKAFPNLSARRLGVMPDLVLDM FINGYYLNVTKTQTTDVNRTYQ EKDKRGGIFDAVFTRGDQSKLL TSRHDFKEKGLKEISDLIKQEL TEGKALGLSHTYANVRINHVIN LWGADFDSDGNLKAIYVTDSDS | APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP | VTSVWTKGVTPPADFTQGEDVFHAPYVANQGWYDITKT FNGKDDLLCGAATAGNMLHWWFDQNKEYIEAYLKKHPE KQKIMFGDQELLDVRKAINTKGSQKNSELFNYFRDKAF PNLSARRLGVMPDLVLDMFINGYYLNVTKTQTTDVNRT YQEKDKRGGIFDAVFTRGDQSKLLTSRHDFKEKGLKEI SDLIKQELTEGKALGLSHTYANVRINHVINLWGADFDS DGNLKAIYVTDSDSNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR |

TABLE 7-continued

| ID | N-terminus Protease Moiety | C-terminus Fc Moiety | Full length Sequence |
|---|---|---|---|
| | NASIGMKKYFVGVNSAGKVAIS AKEIKEDNIGAQVLGLFTLSTG QDIWNQTN (SEQ ID NO: 760) | VLDSDGSFFLYSKLTV DKSRWQQGNVFSCSVM HEALHNHYTQKSLSLS PG (SEQ ID NO: 23) | EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1030) |
| VRT-9 | ITSVWTKGVTPPAKFTQGEDVF HAPYVANQGWYDITKTFNGKDD LLCGAATAGNMLHWWFDQNKEE IEAYLKKHPEKQKIMFGDQELL DVRKVINTKDSQTNSALFNYFK DKAFPNLSARRLGVMPDLVLDM FINGYYLNVYKTQTTDVNRTYQ TKDRRGGIFDAVFTRGDQSKLL TERHDFKEKTLKEISDLIKQEL TEGKALGLSHTYANVRINHVIN LWGADFDSNGNLEAIYVTDSDS NASIGMKKYFVGVNSAGKVAIS AKEIKEDNIGAQVLGLFTLSTG QDIWNQTN (SEQ ID NO: 761) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | ITSVWTKGVTPPAKFTQGEDVFHAPYVANQGWYDITKT FNGKDDLLCGAATAGNMLHWWFDQNKEEIEAYLKKHPE KQKIMFGDQELLDVRKVINTKDSQTNSALFNYFKDKAF PNLSARRLGVMPDLVLDMFINGYYLNVYKTQTTDVNRT YQTKDRRGGIFDAVFTRGDQSKLLTERHDFKEKTLKEI SDLIKQELTEGKALGLSHTYANVRINHVINLWGADFDS NGNLEAIYVTDSDSNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1031) |
| VRT-10 | TITSVWTKGVTPPTPEDFRYNN EDVLHAPYVANQGWYDITKTFD GKDNLLCGAATAGNMLHWWFDQ NKEEIERYLKKHPEKQKIIFNN QELFDVKAAIDTKDSQTNSKLF NYFRDKAFPNLSARQLGVMPDL VLDMFINGYYLNLGKTQSTDVN RPYQDKDKRGGIFDAVFTRGDQ TTLLTARHDLKNKGLNEISDLI KQELTEGKALALSHTYANVRIN HVINLWGADFDAEGNLIAIYVT DSDANASIGMKKYFVGVNANGK VAISAKKIEGDNIGAQVLGLFT LSTGQDIWQKLS (SEQ ID NO: 762) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | TITSVWTKGVTPPTPEDFRYNNEDVLHAPYVANQGWYD ITKTFDGKDNLLCGAATAGNMLHWWFDQNKEEIERYLK KHPEKQKIIFNNQELFDVKAAIDTKDSQTNSKLFNYFR DKAFPNLSARQLGVMPDLVLDMFINGYYLNLGKTQSTD VNRPYQDKDKRGGIFDAVFTRGDQTTLLTARHDLKNKG LNEISDLIKQELTEGKALALSHTYANVRINHVINLWGA DFDAEGNLIAIYVTDSDANASIGMKKYFVGVNANGKVA ISAKKIEGDNIGAQVLGLFTLSTGQDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1032) |
| VRT-11 | QITSVWTKGVTPPTPEQFRYNN EDVIHAPYLANQGWYDITKTFN GKDNLLCGAATAGNMLHWWFDQ NKTEIEAYLSKHPEKQKIIFNN QELFDLKAAIDTKDSQTNSQLF NYFRDKAFPNLSARQLGVMPDL VLDMFINGYYLNVFKTQSTDVN RPYQDKDKRGGIFDAVFTRGDQ TTLLTARHDLKNKTLNDISTLI KQELTEGKALALSHTYANVSIS HVINLWGADFNAEGNLEAIYVT DSDSNASIGMKKYFVGVNAHGK VAISAKKIEGENIGAQVLGLFT LSSGKDIWQKLS (SEQ ID NO: 763) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPPTPEQFRYNNEDVIHAPYLANQGWYD ITKTFNGKDNLLCGAATAGNMLHWWFDQNKTEIEAYLS KHPEKQKIIFNNQELFDLKAAIDTKDSQTNSQLFNYFR DKAFPNLSARQLGVMPDLVLDMFINGYYLNVFKTQSTD VNRPYQDKDKRGGIFDAVFTRGDQTTLLTARHDLKNKT LNDISTLIKQELTEGKALALSHTYANVSISHVINLWGA DFNAEGNLEAIYVTDSDSNASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1033) |
| VRT-12 | QITSVWTKGVTPLTPEQFRYNN EDVIHAPYLANQGWYDITKTFN GKDNLLCGAATAGNMLHWWFDQ NKTEIEAYLKKHPEKQKIIFNN QELFDLKAAIDTKDSQTNSQLF NYFRDKAFPNLSARQLGVMPDL VLDMFINGYYLNVFKTQSTDVN RPYQDKDKRGGIFDAVFTRGDQ TTLLTARHDLKNKGLNEISTLI KQELTEGKALALSHTYANVSIS HVINLWGADFNAEGNLEAIYVT DSDSNASIGMKKYFVGVNAHGK VAISAKKIEGENIGAQVLGLFT LSSGKDIWQKLS (SEQ ID NO: 764) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPLTPEQFRYNNEDVIHAPYLANQGWYD ITKTFNGKDNLLCGAATAGNMLHWWFDQNKTEIEAYLK KHPEKQKIIFNNQELFDLKAAIDTKDSQTNSQLFNYFR DKAFPNLSARQLGVMPDLVLDMFINGYYLNVFKTQSTD VNRPYQDKDKRGGIFDAVFTRGDQTTLLTARHDLKNKG LNEISTLIKQELTEGKALALSHTYANVSISHVINLWGA DFNAEGNLEAIYVTDSDSNASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1034) |
| VRT-13 | QITSVWTKGVTPPTPEQFRYNN EDVFHAPYTAHQGWYDITKTFD GKDNLLCGAATAGNMLHWWFDQ | DKTHTCPPCPAPEAAG APSVFLFPPKPKDTLM ISRTPEVTCVVVDVSH | QITSVWTKGVTPPTPEQFRYNNEDVFHAPYTAHQGWYD ITKTFDGKDNLLCGAATAGNMLHWWFDQNKTEIEAYLS KHPEKQKIIFNNQELFDLKAAIDTKDSQTNSALFNYFR |

TABLE 7-continued

| ID | N-terminus Protease Moiety | C-terminus Fc Moiety | Full length Sequence |
|---|---|---|---|
| | NKTEIEAYLSKHPEKQKIIFNN QELFDLKAAIDTKDSQTNSALF NYFRDKAFPNLSARQLGVMPDL VLDMFINGYYLNVFKTQSTDVN RPYQDKDKRGGIFDAVFTRGDQ TTLLTARHDLKNKTLNDISTII KQELTEGRALALSHTYANVSIS HVINLWGADFNAEGNLEAIYVT DSDSNASIGMKKYFVGVNASGK VAISAKKIEGENIGAQVLGLFT LSSGKDIWQKLS (SEQ ID NO: 765) | EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | DKAFPNLSARQLGVMPDLVLDMFINGYYLNVFKTQSTD VNRPYQDKDKRGGIFDAVFTRGDQTTLLTARHDLKNKT LNDISTIIKQELTEGRALALSHTYANVSISHVINLWGA DFNAEGNLEAIYVTDSDSNASIGMKKYFVGVNASGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1035) |
| VRT-14 | SQTEDSESLQRLRDIEDFQAEK KKQNVVYTKWLDGVDVKDHDFR KIVDGNIAYYATPLLNGRGFYD INKDFNRDSDKCAAAVAANMFH YWLDRNRDNVDRFLRQNPEKHG IIELPDGQLKLSDFLNTYESDD GYRDKSKLFDFISNNFNGPVWT DKLLDNYINGYAYNYKYGRTIE DPTKNTSKINFFKEVFNEKILT NNHSIRNQNEFSVLLSEALYTG KAIGLSYGPAGLRHSLGHIISV WGADLDADGNVVAIYVTDSDDK KLTIGDERVGLKRYKISTDDEG RLRLTAYEETHNTGGQIRGLWT LDTGKQAWADYFDKTEQTGTDQ AEQ (SEQ ID NO: 766) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKKQNVVYTKWLDGVDV KDHDFRKIVDGNIAYYATPLLNGRGFYDINKDFNRDSD KCAAAVAANMFHYWLDRNRDNVDRFLRQNPEKHGIIEL PDGQLKLSDFLNTYESDDGYRDKSKLFDFISNNFNGPV WTDKLLDNYINGYAYNYKYGRTIEDPTKNTSKINFFKE VFNEKILTNNHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1036) |
| VRT-15 | SQTEDSESLQRLRDIEDFQAEK KKQNVVYTKWLDGVDVKDHDFR KIVDGNIAYYATPLLNGRGFYD INKDFNRDSDKCAAAVAANMFH YWLDINRDNVDRFLRQNPEKHG IIELPDGQLKLSDFLNTYESDH GYRDKSKLFDFISNNFNGPVWT DKLLDNYINGYAYNYKYGRTIE DPTKNTSKINFFKEVFNEKILT NNHSIRNQNEFSVLLSEALYTG KAIGLSYGPAGLRHSLGHIISV WGADLDADGNVVAIYVTDSDDK KLTIGDERVGLKRYKISTDDEG RLRLTAYEETHNTGGQIRGLWT LDTGKQAWADYFDKTEQTGTDQ AEQ (SEQ ID NO: 767) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKKQNVVYTKWLDGVDV KDHDFRKIVDGNIAYYATPLLNGRGFYDINKDFNRDSD KCAAAVAANMFHYWLDINRDNVDRFLRQNPEKHGIIEL PDGQLKLSDFLNTYESDHGYRDKSKLFDFISNNFNGPV WTDKLLDNYINGYAYNYKYGRTIEDPTKNTSKINFFKE VFNEKILTNNHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1037) |
| VRT-16 | VTSVWTKGVTPPANFTQGEDVF HAPYVANQGWYDITKTFNGKDN LLCGAATAGNMLHWWFDQNKDQ IKRYLEEHPEKQKINFNGEQLF DVKEAIDTKNHQLDSKLFEYFK EKAFPYLSTKHLGVFPDHVIDM FINGYRLSLTNHGPTPVKEGSK DKRGGIFDAVFTRGVQSKLLTS RHDFKEKNLKEISDLIKKELTE GKALGLSHTYANVRINHVINLW GADFDSNGNLKAIYVTDSDTNA SIGMKKYFVGVNSAGKVAISAK EIKEDNIGAQVLGLFTLSTGQD SWNQTN (SEQ ID NO: 768) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYVANQGWYDITKT FNGKDNLLCGAATAGNMLHWWFDQNKDQIKRYLEEHPE KQKINFNGEQLFDVKEAIDTKNHQLDSKLFEYFKEKAF PYLSTKHLGVFPDHVIDMFINGYRLSLTNHGPTPVKEG SKDKRGGIFDAVFTRGVQSKLLTSRHDFKEKNLKEISD LIKKELTEGKALGLSHTYANVRINHVINLWGADFDSNG NLKAIYVTDSDTNASIGMKKYFVGVNSAGKVAISAKEI KEDNIGAQVLGLFTLSTGQDSWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1038) |
| VRT-17 | VTSVWTKGVTPPAKFTQGEDVF HAPYVANQGWYDITKTFNGKDN LLCGAATAGNMLHWWFDQNKEK IEAYLKKHPDKQKIIFGDQELL DVRKVINTKGDQTNSELFNYFR DKAFPGLSARRIGVFPDLVLDM FINGYYLNVKTQTTDVNRTYQ EKDRRGGIFDAVFTRGVQSKLL TSRHDFKEKNLKEISDLIKKEL TEGKALGLSHTYANVRINHVIN LWGADFDSNGNLKAIYVTDSDT NASIGMKKYFVGVNSAGKVAIS | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV | VTSVWTKGVTPPAKFTQGEDVFHAPYVANQGWYDITKT FNGKDNLLCGAATAGNMLHWWFDQNKEKIEAYLKKHPD KQKIIFGDQELLDVRKVINTKGDQTNSELFNYFRDKAF PGLSARRIGVFPDLVLDMFINGYYLNVKTQTTDVNRTY QEKDRRGGIFDAVFTRGVQSKLLTSRHDFKEKNLKEI SDLIKKELTEGKALGLSHTYANVRINHVINLWGADFDS NGNLKAIYVTDSDTNASIGMKKYFVGVNSAGKVAISAK EIKEDNIGAQVLGLFTLSTGQDSWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE |

TABLE 7-continued

| ID | N-terminus Protease Moiety | C-terminus Fc Moiety | Full length Sequence |
|---|---|---|---|
| | AKEIKEDNIGAQVLGLFTLSTG QDSWNQTN (SEQ ID NO: 769) | DKSRWQQGNVFSCSVM HEALHNHYTQKSLSLS PG (SEQ ID NO: 23) | SNGQPENNYKTTPPVLDSDGSFFLYSKLTVDKSRWQQG NVFSCSVMHEALHNHYTQKSLSLSPG (SEQ ID NO: 1039) |
| VRT-18 | QITSVWTKGVTPLTPEQFRYNN EDVIHAPYLAHQGWYDITKAFD GKDNLLCGAATAGNMLHWWFDQ NKTEIEAYLSKHPEKQKIIFNN QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNGLNDISTII KQELTEGRALALSHTYANVRIS HVINLWGADFNAEGNLEAIYVT DSDANASIGMKKYFVGINAHGH VAISAKKIEGENIGAQVLGLFT LSSGKDIWQKLS (SEQ ID NO: 770) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPLTPEQFRYNNEDVIHAPYLAHQGWYD ITKAFDGKDNLLCGAATAGNMLHWWFDQNKTEIEAYLS KHPEKQKIIFNNQELFDLKAAIDTKDSQTNSQLFNYFR DKAFPGLSARQLGVFPDLVLDMFINGYYLNVFKTQSTD VNRPYQDKDKRGGIFDAVFTRGVQTTLLTARHDLKNKG LNDISTIIKQELTEGRALALSHTYANVRISHVINLWGA DFNAEGNLEAIYVTDSDANASIGMKKYFVGINAHGHVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1040) |
| VRT-19 | SQTEDSESLQRLRDIEDFQAEK KMQNVVYTKWLDGVDVKDHDFR KIVDGNIAYYATPLLNGRGFYD INKDFNRDNDKCAAAVAANMFH YWLDINRDNVDRFLRQNPEKHG IIIELPDGQLKLSDFLNTYESDH GYRDKSLFDFISNNFNGPVWT DKLLDNYINGYAYNYKYGRTIE DSTKNTSKINFFKEVFNEKILT NNHSIRNQNEFSVLLSEALYTG KAIGLSYGPAGLRHSLGHIISV WGADLDADGNVVAIYVTDSDDK KLTIGDERVGLKRYKISTDDEN RLRLTAYEETHNTGGQIRGLWT LDTGKYAWADYFDKTEQTGTDQ AEQ (SEQ ID NO: 771) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKMQNVVYTKWLDGVDV KDHDFRKIVDGNIAYYATPLLNGRGFYDINKDFNRDND KCAAAVAANMFHYWLDINRDNVDRFLRQNPEKHGIIEL PDGQLKLSDFLNTYESDHGYRDKSLFDFISNNFNGPV WTDKLLDNYINGYAYNYKYGRTIEDSTKNTSKINFFKE VFNEKILTNNHSIRNQNEFSVLLSEALYTGKAIGLSYG PAGLRHSLGHIISVWGADLDADGNVVAIYVTDSDDKKL TIGDERVGLKRYKISTDDENRLRLTAYEETHNTGGQIR GLWTLDTGKYAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1041) |
| VRT-20 | VTSVWTKGVTPPANFTQGEDVF HAPYVANQGWYDITKTFNRKDN LLCGAATAGNMLHWWFDQNKDQ IKRYLEEHPEKQKINFKGEQLF DVKEAIDTKNHQLDSKLFEYFK EKAFPYLSTKHLGVFPDHVIDM FINGYRLSLTNHGPTPVKEGSK DKRGGIFDAVFTRGVQSKLLTS RHDFKEKNLKEISDLIKKELTE GKALGLSHTYANVRINHVINLW GADFDSNGNLKAIYVTDSDTEA SIGMKKYFVGVNKAGKVAISAK EIKEDNIGAQVLGLFTLSTGQD SWNQTN (SEQ ID NO: 772) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYVANQGWYDITKT FNRKDNLLCGAATAGNMLHWWFDQNKDQIKRYLEEHPE KQKINFKGEQLFDVKEAIDTKNHQLDSKLFEYFKEKAF PYLSTKHLGVFPDHVIDMFINGYRLSLTNHGPTPVKEG SKDKRGGIFDAVFTRGVQSKLLTSRHDFKEKNLKEISD LIKKELTEGKALGLSHTYANVRINHVINLWGADFDSNG NLKAIYVTDSDTEASIGMKKYFVGVNKAGKVAISAKEI KEDNIGAQVLGLFTLSTGQDSWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1042) |
| VRT-21 | VTSVWTKGVTPPAKFTQGEDVF HAPYVANQGWYDITKTFNRKDN LLCGAATAGNMLHWWFDQNKEK IEAYLKKHPDKQKIIFGDQELL DVRKVINTKGDQTNSELFNYFR DKAFPGLSARRIGVFPDLVLDM FINGYYLNVYKTQTTDVNRT YQEKDRRGGIFDAVFTRGVQSKLL TSRHDFKEKNLKEISDLIKKEL TEGKALGLSHTYANVRINHVIN LWGADFDSNGNLKAIYVTDSDT RASIGMKKYFVGVNAAGKVAIS AKEIKEDNIGAQVLGLFTLSTG QDSWNQTN (SEQ ID NO: 773) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPAKFTQGEDVFHAPYVANQGWYDITKT FNRKDNLLCGAATAGNMLHWWFDQNKEKIEAYLKKHPD KQKIIFGDQELLDVRKVINTKGDQTNSELFNYFRDKAF PGLSARRIGVFPDLVLDMFINGYYLNVYKTQTTDVNRT YQEKDRRGGIFDAVFTRGVQSKLLTSRHDFKEKNLKEI SDLIKKELTEGKALGLSHTYANVRINHVINLWGADFDS NGNLKAIYVTDSDTRASIGMKKYFVGVNAAGKVAISAK EIKEDNIGAQVLGLFTLSTGQDSWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1043) |
| VRT-22 | QITSVWTKGVTPLTPEQFRYN EDVIHAPYLAHQGWYDITKAFD GKDNLLCGAATAGNMLHWWFDQ NKTEIEAYLSKHPEKQKIIFKN | DKTHTCPPCPAPEAAG APSVFLFPPKPKDTLM ISRTPEVTCVVVDVSH EDPEVKFNWYVDGVEV | QITSVWTKGVTPLTPEQFRYNNEDVIHAPYLAHQGWYD ITKAFDGKDNLLCGAATAGNMLHWWFDQNKTEIEAYLS KHPEKQKIIFNNQELFDLKAAIDTKDSQTNSQLFNYFR DKAFPGLSARQLGVFPDLVLDMFINGYYLNVFKTQSTD |

TABLE 7-continued

| ID | N-terminus Protease Moiety | C-terminus Fc Moiety | Full length Sequence |
|---|---|---|---|
| | QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNKGLNDISTII KQELTEGRALALSHTYANVRIS HVINLWGADFNAEGNLEAIYVT DSDTRASIGMKKYFVGINAHGH VAISAKKIEGENIGAQVLGLFT LSSGKDIWQKLS (SEQ ID NO: 774) | HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VNRPYQDKDKRGGIFDAVFTRGVQTTLLTARHDLKNKG LNDISTIIKQELTEGRALALSHTYANVRISHVINLWGA DFNAEGNLEAIYVTDSDTRASIGMKKYFVGINAHGHVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1044) |
| VRT-23 | SQTEDSESLQRLRDIEDFQAEK KMQNVVYTKWLDGVDVKDHDFR KIVDGNIAYYATPLLNGRGFYD INKDFNRDNDKCAAAVAANMFH YWLDINRDNVDRFLRQNPEKHG IIELPDEQLKLSDFLNTYESDH GYRDKSKLFDFISNNFNKPVWT DKLLDNYINGYAYNYKYGRTIE DSTKNTSKINFFKEVFNEKILT NIHSIRNQNEFSVLLSEALYTG KAIGLSYGPAGLRHSLGHIISV WGADLDADGNVVAIYVTDSDDK KLTIGDERVGLKRYKISTDDEN RLRLTAYEETHNTGGQIRGLWT LDTGKYAWADYFDKTEQTGTDQ AEQ (SEQ ID NO: 775) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKMQNVVYTKWLDGVDV KDHDFRKIVDGNIAYYATPLLNGRGFYDINKDFNRDND KCAAAVAANMFHYWLDINRDNVDRFLRQNPEKHGIIEL PDEQLKLSDFLNTYESDHGYRDKSKLFDFISNNFNKPV WTDKLLDNYINGYAYNYKYGRTIEDSTKNTSKINFFKE VFNEKILTNIHSIRNQNEFSVLLSEALYTGKAIGLSYG PAGLRHSLGHIISVWGADLDADGNVVAIYVTDSDDKKL TIGDERVGLKRYKISTDDENRLRLTAYEETHNTGGQIR GLWTLDTGKYAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1045) |
| VRT-24 | VTSVWTKGVTPPANFTQGEDVF HAPYKANQGWYDITKTFNGKDN LLCGAATAGNMLHWWFDQNKDQ IEAYLKEHPEKQKINFNGEQLF DVKEAIDTKDDQTNSKLFEYFK EKAFPYLSTKHLGVFPDHVLDM FINGYRLSLTNHGPTPVKEGSK DKRGGIFDAVFTRGVQSKLLTS RHDFKEKTLKEISDLIKQELTE GKALALSHTYANVRINHVINLW GADFDSNGNLEAIYVTDSDTNA SIGMKKYFVGVNSAGKVAISAK EIEDDNIGAQVLGLFTLSTGQD IWNQTN (SEQ ID NO: 776) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYKANQGWYDITKT FNGKDNLLCGAATAGNMLHWWFDQNKDQIEAYLKEHPE KQKINFNGEQLFDVKEAIDTKDDQTNSKLFEYFKEKAF PYLSTKHLGVFPDHVLDMFINGYRLSLTNHGPTPVKEG SKDKRGGIFDAVFTRGVQSKLLTSRHDFKEKTLKEISD LIKQELTEGKALALSHTYANVRINHVINLWGADFDSNG NLEAIYVTDSDTNASIGMKKYFVGVNSAGKVAISAKEI EDDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1046) |
| VRT-25 | VTSVWTKGVTPPANFTQGEDVF HAPYVANQGWYDITKTFNGKDN LLCGAATAGNMLHWWFDQNKDQ IERYLKEHPEKQKINFNGEQLF DVKEAIDTKDSQTDSKLFEYFK EKAFPYLSTKHLGVFPDHVLDM FINGYRLSLTNHGPTPVKEGSK DKRGGIFDAVFTRGVQSKLLTS RHDFKEKTLKEISDLIKQELTE GKALGLSHTYANVRINHVINLW GADFDSEGNLKAIYVTDSDTNA SIGMKKYFVGVNSAGKVAISAK EIKEDNIGAQVLGLFTLSTGQD IWNQTN (SEQ ID NO: 777) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYVANQGWYDITKT FNGKDNLLCGAATAGNMLHWWFDQNKDQIERYLKEHPE KQKINFNGEQLFDVKEAIDTKDSQTDSKLFEYFKEKAF PYLSTKHLGVFPDHVLDMFINGYRLSLTNHGPTPVKEG SKDKRGGIFDAVFTRGVQSKLLTSRHDFKEKTLKEISD LIKQELTEGKALGLSHTYANVRINHVINLWGADFDSEG NLKAIYVTDSDTNASIGMKKYFVGVNSAGKVAISAKEI KEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1047) |
| VRT-26 | VTSVWTKGVTPPTNFTYGEDVL HAPYVANQGWYDITKTFNGKDN LLCGAATAGNMLHWWFDQNKEQ IENYLKKHPEKQKINFNGEQLF DVKEAIDTKDSQLDSKLFEYFK EKAFPYLSTKHLGVFPDHVIDM FINGYRLSLTNHGPTPVKRGSK DKRGGIFDAVFTRGVQSKLLTN RHDFKEKTLKEISDLIKQELTE GKALGISHTYANVRINHVINLW GADFDAEGNLEAIYVTDSDTNA | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP | VTSVWTKGVTPPTNFTYGEDVLHAPYVANQGWYDITKT FNGKDNLLCGAATAGNMLHWWFDQNKEQIENYLKKHPE KQKINFNGEQLFDVKEAIDTKDSQLDSKLFEYFKEKAF PYLSTKHLGVFPDHVIDMFINGYRLSLTNHGPTPVKRG SKDKRGGIFDAVFTRGVQSKLLTNRHDFKEKTLKEISD LIKQELTEGKALGISHTYANVRINHVINLWGADFDAEG NLEAIYVTDSDTNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP |

TABLE 7-continued

| ID | N-terminus Protease Moiety | C-terminus Fc Moiety | Full length Sequence |
|---|---|---|---|
| | SIGMKKYFVGVNSNGKVAISAK EIEEDNIGAQVLGLFTLSTGQD IWNQTN (SEQ ID NO: 778) | VLDSDGSFFLYSKLTV DKSRWQQGNVFSCSVM HEALHNHYTQKSLSLS PG (SEQ ID NO: 23) | QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1048) |
| VRT-27 | VTSVWTKGVTPPADFTQGEDVF HAPYVANQGWYDITKTFNGKDN LLCGAATAGNMLHWWFDQNKEY IEAYLKKHPEKQKIIFGDQELL DVRKAINTKGSQKNSELFNYFR DKAFPNLSARRLGVPPDLVLDM FINGYYLNVTKTQTTDVNRTYQ EKDKRGGIFDAVFTRGVQSKLL TSRHDFKEKGLKEISDLIKQEL TEGKALGLSHTYANVRINHVIN LWGADFDSDGNLKAIYVTDSDT NASIGMKKYFVGVNSAGKVAIS AKEIKEDNIGAQVLGLFTLSTG QDIWNQTN (SEQ ID NO: 779) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPADFTQGEDVFHAPYVANQGWYDITKT FNGKDNLLCGAATAGNMLHWWFDQNKEYIEAYLKKHPE KQKIIFGDQELLDVRKAINTKGSQKNSELFNYFRDKAF PNLSARRLGVPPDLVLDMFINGYYLNVTKTQTTDVNRT YQEKDKRGGIFDAVFTRGVQSKLLTSRHDFKEKGLKEI SDLIKQELTEGKALGLSHTYANVRINHVINLWGADFDS DGNLKAIYVTDSDTNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1049) |
| VRT-28 | ITSVWTKGVTPPAKFTQGEDVF HAPYVANQGWYDITKTFNGKDN LLCGAATAGNMLHWWFDQNKEE IEAYLKKHPEKQKIIFGDQELL DVRKVINTKDSQTNSALFNYFK DKAFPNLSARRLGVPPDLVLDM FINGYYLNVYKTQTTDVNRTYQ TKDRRGGIFDAVFTRGVQSKLL TERHDFKEKTLKEISDLIKQEL TEGKALGLSHTYANVRINHVIN LWGADFDSNGNLEAIYVTDSDT NASIGMKKYFVGVNSAGKVAIS AKEIKEDNIGAQVLGLFTLSTG QDIWNQTN (SEQ ID NO: 780) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | ITSVWTKGVTPPAKFTQGEDVFHAPYVANQGWYDITKT FNGKDNLLCGAATAGNMLHWWFDQNKEEIEAYLKKHPE KQKIIFGDQELLDVRKVINTKDSQTNSALFNYFKDKAF PNLSARRLGVPPDLVLDMFINGYYLNVYKTQTTDVNRT YQTKDRRGGIFDAVFTRGVQSKLLTERHDFKEKTLKEI SDLIKQELTEGKALGLSHTYANVRINHVINLWGADFDS NGNLEAIYVTDSDTNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1050) |
| VRT-29 | TITSVWTKGVTPPTPEDFRYNN EDVLHAPYVANQGWYDITKTFD GKDNLLCGAATAGNMLHWWFDQ NKEEIERYLKKHPEKQKIIFNN QELFDVKAAIDTKDSQTNSKLF NYFRDKAFPGLSARQLGVFPDL VLDMFINGYYLNLGKTQSTDVN RPYQDKDKRGGIFDAVFTRGVQ TTLLTARHDLKNKGLNEISDLI KQELTEGKALALSHTYANVRIN HVINLWGADFDAEGNLIAIYVT DSDANASIGMKKYFVGVNANGK VAISAKKIEGDNIGAQVLGLFT LSTGQDIWQKLS (SEQ ID NO: 781) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | TITSVWTKGVTPPTPEDFRYNNEDVLHAPYVANQGWYD ITKTFDGKDNLLCGAATAGNMLHWWFDQNKEEIERYLK KHPEKQKIIFNNQELFDVKAAIDTKDSQTNSKLFNYFR DKAFPGLSARQLGVFPDLVLDMFINGYYLNLGKTQSTD VNRPYQDKDKRGGIFDAVFTRGVQTTLLTARHDLKNKG LNEISDLIKQELTEGKALALSHTYANVRINHVINLWGA DFDAEGNLIAIYVTDSDANASIGMKKYFVGVNANGKVA ISAKKIEGDNIGAQVLGLFTLSTGQDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1051) |
| VRT-30 | QITSVWTKGVTPPTPEQFRYNN EDVIHAPYLANQGWYDITKTFN GKDNLLCGAATAGNMLHWWFDQ NKTEIEAYLSKHPEKQKIIFNN QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNKTLNDISTLI KQELTEGKALALSHTYANVRIS HVINLWGADFNAEGNLEAIYVT DSDANASIGMKKYFVGVNAHGK VAISAKKIEGNIGAQVLGLFT LSSGKDIWQKLS (SEQ ID NO: 782) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPPTPEQFRYNNEDVIHAPYLANQGWYD ITKTFNGKDNLLCGAATAGNMLHWWFDQNKTEIEAYLS KHPEKQKIIFNNQELFDLKAAIDTKDSQTNSQLFNYFR DKAFPGLSARQLGVFPDLVLDMFINGYYLNVFKTQSTD VNRPYQDKDKRGGIFDAVFTRGVQTTLLTARHDLKNKT LNDISTLIKQELTEGKALALSHTYANVRISHVINLWGA DFNAEGNLEAIYVTDSDANASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1052) |
| VRT-31 | QITSVWTKGVTPLTPEQFRYNN EDVIHAPYLANQGWYDITKTFN GKDNLLCGAATAGNMLHWWFDQ | DKTHTCPPCPAPEAAG APSVFLFPPKPKDTLM ISRTPEVTCVVVDVSH | QITSVWTKGVTPLTPEQFRYNNEDVIHAPYLANQGWYD ITKTFNGKDNLLCGAATAGNMLHWWFDQNKTEIEAYLK KHPEKQKIIFNNQELFDLKAAIDTKDSQTNSQLFNYFR |

TABLE 7-continued

| ID | N-terminus Protease Moiety | C-terminus Fc Moiety | Full length Sequence |
|---|---|---|---|
| | NKTEIEAYLKKHPEKQKIIFNN QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNKGLNEISTLI KQELTEGKALALSHTYANVRIS HVINLWGADFNAEGNLEAIYVT DSDSNASIGMKKYFVGVNAHGK VAISAKKIEGENIGAQVLGLFT LSSGKDIWQKLS (SEQ ID NO: 783) | EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | DKAFPGLSARQLGVFPDLVLDMFINGYYLNVFKTQSTD VNRPYQDKDKRGGIFDAVFTRGVQTTLLTARHDLKNKG LNEISTLIKQELTEGKALALSHTYANVRISHVINLWGA DFNAEGNLEAIYVTDSDSNASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1053) |
| VRT-32 | QITSVWTKGVTPPTPEQFRYNN EDVFHAPYTAHQGWYDITKTFD GKDNLLCGAATAGNMLHWWFDQ NKTEIEAYLSKHPEKQKIIFNN QELFDLKAAIDTKDSQTNSALF NYFRDKAFPGLSARQLGVFPDL VLDMFINGYYLNVFKTQSTDVN RPYQDKDKRGGIFDAVFTRGVQ TTLLTARHDLKNKILNDISTII KQELTEGRALALSHTYANVRIS HVINLWGADFNAEGNLEAIYVT DSDSNASIGMKKYFVGVNASGK VAISAKKIEGENIGAQVLGLFT LSSGKDIWQKLS (SEQ ID NO: 784) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPPTPEQFRYNNEDVFHAPYTAHQGWYD ITKTFDGKDNLLCGAATAGNMLHWWFDQNKTEIEAYLS KHPEKQKIIFNNQELFDLKAAIDTKDSQTNSALFNYFR DKAFPGLSARQLGVFPDLVLDMFINGYYLNVFKTQSTD VNRPYQDKDKRGGIFDAVFTRGVQTTLLTARHDLKNKT LNDISTIIKQELTEGRALALSHTYANVRISHVINLWGA DFNAEGNLEAIYVTDSDSNASIGMKKYFVGVNASGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1054) |
| VRT-33 | SQTEDSESLQRLRDIEDFQAEK KKQNVVYTKWLDGVDVKDHDFR KIVDGNIAYYATPLLNGRGFYD INKDFNRDNDKCAAAVAANMFH YWLDRNRDNVDRFLRQNPEKHG IIELPDGQLKLSDFLNTYESDD GYRDKSKLFDFISNNFNGPVWT DKLLDNYINGYAYNYKYGRTIE DSTKNTSKINFFKEVFNEKILT NNHSIRNQNEFSVLLSEALYTG KAIGLSYGPAGLRHSLGHIISV WGADLDADGNVVAIYVTDSDDK KLTIGDERVGLKRYKISTDDEG RLRLTAYEETHNTGGQIRGLWT LDTGKQAWADYFDKTEQTGTDQ AEQ (SEQ ID NO: 785) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKKQNVVYTKWLDGVDV KDHDFRKIVDGNIAYYATPLLNGRGFYDINKDFNRDND KCAAAVAANMPHYWLDRNRDNVDRFLRQNPEKHGIIEL PDGQLKLSDFLNTYESDDGYRDKSKLFDFISNNFNGPV WTDKLLDNYINGYAYNYKYGRTIEDSTKNTSKINFFKE VFNEKILTNNHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1055) |
| VRT-34 | SQTEDSESLQRLRDIEDFQAEK KKQNVVYTKWLDGVDVKDHDFR KIVDGNIAYYATPLLNGRGFYD INKDFNRDNDKCAAAVAANMFH YWLDINRDNVDRFLRQNPEKHG IIELPDGQLKLSDFLNTYESDH GYRDKSKLFDFISNNFNGPVWT DKLLDNYINGYAYNYKYGRTIE DSTKNTSKINFFKEVFNEKILT NNHSIRNQNEFSVLLSEALYTG KAIGLSYGPAGLRHSLGHIISV WGADLDADGNVVAIYVTDSDDK KLTIGDERVGLKRYKISTDDEG RLRLTAYEETHNTGGQIRGLWT LDTGKQAWADYFDKTEQTGTDQ AEQ (SEQ ID NO: 786) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKKQNVVYTKWLDGVDV KDHDFRKIVDGNIAYYATPLLNGRGFYDINKDFNRDND KCAAAVAANMPHYWLDINRDNVDRFLRQNPEKHGIIEL PDGQLKLSDFLNTYESDHGYRDKSKLFDFISNNFNGPV WTDKLLDNYINGYAYNYKYGRTIEDSTKNTSKINFFKE VFNEKILTNNHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1056) |
| VRT-35 | VTSVWTKGVTPPANFTQGEDVF HAPYKANQGWYDITKTFNRKDN LLCGAATAGNMLHWWFDQNKDQ IEAYLKEHPEKQKINFKGEQLF DVKEAIDTKDDQTNSKLFEYFK EKAFPYLSTKHLGVFPDHVLDM FINGYRLSLTNHGPTPVKEGSK DKRGGIFDAVFTRGVQSKLLTS RHDFKEKTLKEISDLIKQELTE GKALALSHTYANVRINHVINLW GADFDSNGLEAIYVTDSDTEA SIGMKKYFVGVNKAGKVAISAK | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV | VTSVWTKGVTPPANFTQGEDVFHAPYKANQGWYDITKT FNRKDNLLCGAATAGNMLHWWFDQNKDQIEAYLKEHPE KQKINFKGEQLFDVKEAIDTKDDQTNSKLFEYFKEKAF PYLSTKHLGVFPDHVLDMFINGYRLSLTNHGPTPVKEG SKDKRGGIFDAVFTRGVQSKLLTSRHDFKEKTLKEISD LIKQELTEGKALALSHTYANVRINHVINLWGADFDSNG NLEAIYVTDSDTEASIGMKKYFVGVNKAGKVAISAKEI EDDNIGAQVLGLFTLSGQDIWQNTNDKTHTCPPCPAP EAAGAPSVFLFPPKPKDTLMISRTPEVTCVVVDVSHED PEVKFNWYVDGVEVHNAKTKPREEQQNSTYRVVSLTV LHQDWLNGKEYKCKVSNKALKAPIEKTISKAKGQPREP QVYTLPPSRDELTKNQVSLTCLVKGFYPSDIAVEWESN |

TABLE 7-continued

| ID | N-terminus Protease Moiety | C-terminus Fc Moiety | Full length Sequence |
|---|---|---|---|
| | EIEDDNIGAQVLGLFTLSTGQD IWNQTN (SEQ ID NO: 787) | DKSRWQQGNVFSCSVM HEALHNHYTQKSLSLS PG (SEQ ID NO: 23) | GQPENNYKTTPPVLDSDGSFFLYSKLTVDKSRWQQGNV FSCSVMHEALHNHYTQKSLSLSPG (SEQ ID NO: 1057) |
| VRT-36 | VTSVWTKGVTPPANFTQGEDVF HAPYVANQGWYDITKTFNRKDN LLCGAATAGNMLHWWFDQNKDQ IERYLKEHPEKQKINFKGEQLF DVKEAIDTKDSQTDSKLFEYFK EKAFPYLSTKHLGVFPDHVLDM FINGYRLSLTNHGPTPVKEGSK DKRGGIFDAVFTRGVQSKLLTS RHDFKEKTLKEISDLIKQELTE GKALGLSHTYANVRINHVINLW GADFDSEGNLKAIYVTDSDTEA SIGMKKYFVGVNKAGKVAISAK EIEDNIGAQVLGLFTLSTGQD IWNQTN (SEQ ID NO: 788) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPANFTQGEDVFHAPYVANQGWYDITKT FNRKDNLLCGAATAGNMLHWWFDQNKDQIERYLKEHPE KQKINFKGEQLFDVKEAIDTKDSQTDSKLFEYFKEKAF PYLSTKHLGVFPDHVLDMFINGYRLSLTNHGPTPVKEG SKDKRGGIFDAVFTRGVQSKLLTSRHDFKEKTLKEISD LIKQELTEGKALGLSHTYANVRINHVINLWGADFDSEG NLKAIYVTDSDTEASIGMKKYFVGVNKAGKVAISAKEI KEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1058) |
| VRT-37 | VTSVWTKGVTPPTNFTYGEDVL HAPYVANQGWYDITKTFNRKDN LLCGAATAGNMLHWWFDQNKEQ IENYLKKHPEKQKINFKGEQLF DVKEAIDTKDSQLDSKLFEYFK EKAFPYLSTKHLGVFPDHVIDM FINGYRLSLTNHGPTPVKRGSK DKRGGIFDAVFTRGVQSKLLIN RHDFKEKTLKEISDLIKQELTE GKALGISHTYANVRINHVINLW GADFDAEGNLEAIYVTDSDTEA SIGMKKYFVGVNKNGKVAISAK EIEEDNIGAQVLGLFTLSTGQD IWNQTN (SEQ ID NO: 789) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTNFTYGEDVLHAPYVANQGWYDITKT FNRKDNLLCGAATAGNMLHWWFDQNKEQIENYLKKHPE KQKINFKGEQLFDVKEAIDTKDSQLDSKLFEYFKEKAF PYLSTKHLGVFPDHVIDMFINGYRLSLTNHGPTPVKRG SKDKRGGIFDAVFTRGVQSKLLINRHDFKEKTLKEISD LIKQELTEGKALGISHTYANVRINHVINLWGADFDAEG NLEAIYVTDSDTEASIGMKKYFVGVNKNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1059) |
| VRT-38 | VTSVWTKGVTPPADFTQGEDVF HAPYVANQGWYDITKTFNRKDN LLCGAATAGNMLHWWFDQNKEY IEAYLKKHPEKQKIIFGDQELL DVRKAINTKGSQKNSELFNYFR DKAFPNLSARRLGVFPDLVLDM FINGYYLNVTKTQTTDVNRTYQ EKDKRGGIFDAVFTRGVQSKLL TSRHDFKEKGLKEISDLIKQEL TEGKALGLSHTYANVRINHVIN LWGADFDSDGNLKAIYVTDSDT RASIGMKKYFVGVNAAGKVAIS AKEIKEDNIGAQVLGLFTLSTG QDIWNQTN (SEQ ID NO: 790) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPADFTQGEDVFHAPYVANQGWYDITKT FNRKDNLLCGAATAGNMLHWWFDQNKEYIEAYLKKHPE KQKIIFGDQELLDVRKAINTKGSQKNSELFNYFRDKAF PNLSARRLGVFPDLVLDMFINGYYLNVTKTQTTDVNRT YQEKDKRGGIFDAVFTRGVQSKLLTSRHDFKEKGLKEI SDLIKQELTEGKALGLSHTYANVRINHVINLWGADFDS DGNLKAIYVTDSDTRASIGMKKYFVGVNAAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1060) |
| VRT-39 | ITSVWTKGVTPPAKFTQGEDVF HAPYVANQGWYDITKTFNRKDN LLCGAATAGNMLHWWFDQNKEE IEAYLKKHPEKQKIIFGDQELL DVRKVINTKDSQTNSALFNYFK DKAFPNLSARRLGVFPDLVLDM FINGYYLNVYKTQTTDVNRTYQ TKDRRGGIFDAVFTRGVQSKLL TERHDFKEKTLKEISDLIKQEL TEGKALGLSHTYANVRINHVIN LWGADFDSNGNLEAIYVTDSDT RASIGMKKYFVGVNAAGKVAIS AKEIKEDNIGAQVLGLFTLSTG QDIWNQTN (SEQ ID NO: 791) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | ITSVWTKGVTPPAKFTQGEDVFHAPYVANQGWYDITKT FNRKDNLLCGAATAGNMLHWWFDQNKEEIEAYLKKHPE KQKIIFGDQELLDVRKVINTKDSQTNSALFNYFKDKAF PNLSARRLGVFPDLVLDMFINGYYLNVYKTQTTDVNRT YQTKDRRGGIFDAVFTRGVQSKLLTERHDFKEKTLKEI SDLIKQELTEGKALGLSHTYANVRINHVINLWGADFDS NGNLEAIYVTDSDTRASIGMKKYFVGVNAAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1061) |
| VRT-40 | TITSVWTKGVTPPTPEDFRYYN EDVLHAPYVANQGWYDITKTFD GKDNLLCGAATAGNMLHWWFDQ NKEEIERYLKKHPEKQKIIFKN | DKTHTCPPCPAPEAAG APSVFLFPPKPKDTLM ISRTPEVTCVVVDVSH EDPEVKFNWYVDGVEV | TITSVWTKGVTPPTPEDFRYYNEDVLHAPYVANQGWYD ITKTFDGKDNLLCGAATAGNMLHWWFDQNKEEIERYLK KHPEKQKIIFKNQELFDVKAAIDTKDSQTNSKLFNYFR DKAFPGLSARQLGVFPDLVLDMFINGYYLNLGKTQSTD |

TABLE 7-continued

| ID | N-terminus Protease Moiety | C-terminus Fc Moiety | Full length Sequence |
|---|---|---|---|
| | QELFDVKAAIDTKDSQTNSKLF NYFRDKAFPGLSARQLGVFPDL VLDMFINGYYLNLGKTQSTDVN RPYQDKDKRGGIFDAVFTRGVQ TTLLTARHDLKNKGLNEISDLI KQELTEGKALALSHTYANVRIN HVINLWGADFDAEGNLIAIYVT DSDTRASIGMKKYFVGVNANGK VAISAKKIEGDNIGAQVLGLFT LSTGQDIWQKLS (SEQ ID NO: 792) | HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VNRPYQDKDKRGGIFDAVFTRGVQTTLLLTARHDLKNKG LNEISDLIKQELTEGKALALSHTYANVRINHVINLWGA DFDAEGNLIAIYVTDSDTRASIGMKKYFVGVNANGKVA ISAKKIEGDNIGAQVLGLFTLSTGQDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1062) |
| VRT-41 | QITSVWTKGVTPPTPEQFRYYN EDVIHAPYLANQGWYDITKTFN GKDNLLCGAATAGNMLHWWFDQ NKTEIEAYLSKHPEKQKIIFKN QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNKTLNDISTLI KQELTEGKALALSHTYANVRIS HVINLWGADFNAEGNLEAIYVT DSDTRASIGMKKYFVGVNAHGK VAISAKKIEGENIGAQVLGLFT LSSGKDIWQKLS (SEQ ID NO: 793) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPPTPEQFRYYNEDVIHAPYLANQGWYD ITKTFNGKDNLLCGAATAGNMLHWWFDQNKTEIEAYLS KHPEKQKIIFKNQELFDLKAAIDTKDSQTNSQLFNYFR DKAFPGLSARQLGVFPDLVLDMFINGYYLNVFKTQSTD VNRPYQDKDKRGGIFDAVFTRGVQTTLLTARHDLKNKT LNDISTLIKQELTEGKALALSHTYANVRISHVINLWGA DFNAEGNLEAIYVTDSDTRASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1063) |
| VRT-42 | QITSVWTKGVTPLTPEQFRYYN EDVIHAPYLANQGWYDITKTFN GKDNLLCGAATAGNMLHWWFDQ NKTEIEAYLKKHPEKQKIIFKN QELFDLKAAIDTKDSQTNSQLF NYFRDKAFPGLSARQLGVFPDL VLDMFINGYYLNVFKTQSTDVN RPYQDKDKRGGIFDAVFTRGVQ TTLLTARHDLKNKGLNEISTLI KQELTEGKALALSHTYANVRIS HVINLWGADFNAEGNLEAIYVT DSDSRASIGMKKYFVGVNAHGK VAISAKKIEGENIGAQVLGLFT LSSGKDIWQKLS (SEQ ID NO: 794) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPLTPEQFRYYNEDVIHAPYLANQGWYD ITKTFNGKDNLLCGAATAGNMLHWWFDQNKTEIEAYLK KHPEKQKIIFKNQELFDLKAAIDTKDSQTNSQLFNYFR DKAFPGLSARQLGVFPDLVLDMFINGYYLNVFKTQSTD VNRPYQDKDKRGGIFDAVFTRGVQTTLLTARHDLKNKG LNEISTLIKQELTEGKALALSHTYANVRISHVINLWGA DFNAEGNLEAIYVTDSDSRASIGMKKYFVGVNAHGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1064) |
| VRT-43 | QITSVWTKGVTPPTPEQFRYYN EDVFHAPYTAHQGWYDITKTFD GKDNLLCGAATAGNMLHWWFDQ NKTEIEAYLSKHPEKQKIIFKN QELFDLKAAIDTKDSQTNSALF NYFRDKAFPGLSARQLGVFPDL VLDMFINGYYLNVFKTQSTDVN RPYQDKDKRGGIFDAVFTRGVQ TTLLTARHDLKNKTLNDISTII KQELTEGRALALSHTYANVRIS HVINLWGADFNAEGNLEAIYVT DSDSRASIGMKKYFVGVNASGK VAISAKKIEGENIGAQVLGLFT LSSGKDIWQKLS (SEQ ID NO: 795) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | QITSVWTKGVTPPTPEQFRYYNEDVFHAPYTAHQGWYD ITKTFDGKDNLLCGAATAGNMLHWWFDQNKTEIEAYLS KHPEKQKIIFKNQELFDLKAAIDTKDSQTNSALFNYFR DKAFPGLSARQLGVFPDLVLDMFINGYYLNVFKTQSTD VNRPYQDKDKRGGIFDAVFTRGVQTTLLTARHDLKNKT LNDISTIIKQELTEGRALALSHTYANVRISHVINLWGA DFNAEGNLEAIYVTDSDSRASIGMKKYFVGVNASGKVA ISAKKIEGENIGAQVLGLFTLSSGKDIWQKLSDKTHTC PPCPAPEAAGAPSVFLFPPKPKDTLMISRTPEVTCVVV DVSHEDPEVKFNWYVDGVEVHNAKTKPREEQQNSTYRV VSVLTVLHQDWLNGKEYKCKVSNKALKAPIEKTISKAK GQPREPQVYTLPPSRDELTKNQVSLTCLVKGFYPSDIA VEWESNGQPENNYKTTPPVLDSDGSFFLYSKLTVDKSR WQQGNVFSCSVMHEALHNHYTQKSLSLSPG (SEQ ID NO: 1065) |
| VRT-44 | SQTEDSESLQRLRDIEDFQAEK KKQNVVYTKWLDGVDVKDHDFR KIVDGNIAYYATPLLNGRGFYD INKDFNRDNDKCAAAVAANMFH YWLDRNRDNVDRFLRQNPEKHG IIELPDEQLKLSDFLNTYESDD GYRDKSKLFDFISNNFNKPVWT DKLLDNYINGYAYNYKYGRTIE DSTKNTSKINFFKEVFNEKILT NIHSIRNQNEFSVLLSEALYTG KAIGLSYGPAGLRHSLGHIISV WGADLDADGNVVAIYVTDSDDK KLTIGDERVGLKRYKISTDDEG | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM | SQTEDSESLQRLRDIEDFQAEKKKQNVVYTKWLDGVDV KDHDFRKIVDGNIAYYATPLLNGRGFYDINKDFNRDND KCAAAVAANMFHYWLDRNRDNVDRFLRQNPEKHGIIEL PDEQLKLSDFLNTYESDDGYRDKSKLFDFISNNFNKPV WTDKLLDNYINGYAYNYKYGRTIEDSTKNTSKINFFKE VFNEKILTNIHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW |

TABLE 7-continued

| ID | N-terminus Protease Moiety | C-terminus Fc Moiety | Full length Sequence |
|---|---|---|---|
| | RLRLTAYEETHNTGGQIRGLWT LDTGKQAWADYFDKTEQTGTDQ AEQ (SEQ ID NO: 796) | HEALHNHYTQKSLSLS PG (SEQ ID NO: 23) | ESNGQPENNYKTTPPVLDSDGSFFLYSKLTVDKSRWQQ GNVFSCSVMHEALHNHYTQKSLSLSPG (SEQ ID NO: 1066) |
| VRT-45 | SQTEDSESLQRLRDIEDFQAEK KKQNVVYTKWLDGVDVKDHDFR KIVDGNIAYYATPLLNGRGFYD INKDFNRDNDKCAAAVAANMFH YWLDINRDNVDRFLRQNPEKHG IIELPDEQLKLSDFLNTYESDH GYRDKSKLFDFISNNFNKPVWT DKLLDNYINGYAYNYKYGRTIE DSTKNTSKINFFKEVFNEKILT NIHSIRNQNEFSVLLSEALYTG KAIGLSYGPAGLRHSLGHIISV WGADLDADGNVVAIYVTDSDDK KLTIGDERVGLKRYKISTDDEG RLRLTAYEETHNTGGQIRGLWT LDTGKQAWADYFDKTEQTGTDQ AEQ (SEQ ID NO: 797) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | SQTEDSESLQRLRDIEDFQAEKKKQNVVYTKWLDGVDV KDHDFRKIVDGNIAYYATPLLNGRGFYDINKDFNRDND KCAAAVAANMFHYWLDINRDNVDRFLRQNPEKHGIIEL PDEQLKLSDFLNTYESDHGYRDKSKLFDFISNNFNKPV WTDKLLDNYINGYAYNYKYGRTIEDSTKNTSKINFFKE VFNEKILTNIHSIRNQNEFSVLLSEALYTGKAIGLSYG PAGLRHSLGHIISVWGADLDADGNVVAIYVTDSDDKKL TIGDERVGLKRYKISTDDEGRLRLTAYEETHNTGGQIR GLWTLDTGKQAWADYFDKTEQTGTDQAEQDKTHTCPPC PAPEAAGAPSVFLFPPKPKDTLMISRTPEVTCVVVDVS HEDPEVKFNWYVDGVEVHNAKTKPREEQQNSTYRVVSV LTVLHQDWLNGKEYKCKVSNKALKAPIEKTISKAKGQP REPQVYTLPPSRDELTKNQVSLTCLVKGFYPSDIAVEW ESNGQPENNYKTTPPVLDSDGSFFLYSKLTVDKSRWQQ GNVFSCSVMHEALHNHYTQKSLSLSPG (SEQ ID NO: 1067) |
| VRT-46 | VTSVWTKGVTPPTDFIYGEDVL HAPYKAGQGWYDITKTFNGKDD LLCGAATAGNMLHWWFDQNKEQ IENYLKKHPEKQKINFNGEQMF DVKEAIDTKDSQLDSKLFEYFK EKAFPYLSTKHLGVFPDHVIDM FINGYRLSLTNHGPTPVKRGSK DPRGGIFDAVFTRGDQSKLLIN RHDFKEKTLKEISDLIKQELTE GKALGISHTYANVRINHVINLW GADFDAEGNLEAIYVTDSDSNA SIGMKKYFVGVNSNGKVAISAK EIEEDNIGAQVLGLFTLSTGQD IWNQTN (SEQ ID NO: 798) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIYGEDVLHAPYKAGQGWYDITKT FNGKDDLLCGAATAGNMLHWWFDQNKEQIENYLKKHPE KQKINFNGEQMFDVKEAIDTKDSQLDSKLFEYFKEKAF PYLSTKHLGVFPDHVIDMFINGYRLSLTNHGPTPVKRG SKDPRGGIFDAVFTRGDQSKLLTNRHDFKEKTLKEISD LIKQELTEGKALGISHTYANVRINHVINLWGADFDAEG NLEAIYVTDSDSNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1068) |
| VRT-47 | VTSVWTKGVTPPTDFIYGEDVL HAPYKAGQGWYDITKTFNGKDD LLCGAATAGNMLHWWFDQNKEQ IENYLKKHPEKQKINFNGEQMF DVKEAIDTKDSQLDSKLFEYFK EKAFPYLSTKHLGVFPDHVIDM FINGYRLSLTNHGPTPVKRGSK DPRGGIFDAVFTRGDQSKLLTN RHDLKNKTLKEISDLIKQELTE GKALGISHTYANVRINHVINLW GADFDAEGNLEAIYVTDSDSNA SIGMKKYFVGVNSNGKVAISAK EIEEDNIGAQVLGLFTLSTGQD IWNQTN (SEQ ID NO: 799) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIYGEDVLHAPYKAGQGWYDITKT FNGKDDLLCGAATAGNMLHWWFDQNKEQIENYLKKHPE KQKINFNGEQMFDVKEAIDTKDSQLDSKLFEYFKEKAF PYLSTKHLGVFPDHVIDMFINGYRLSLTNHGPTPVKRG SKDPRGGIFDAVFTRGDQSKLLTNRHDLKNKTLKEISD LIKQELTEGKALGISHTYANVRINHVINLWGADFDAEG NLEAIYVTDSDSNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1069) |
| VRT-48 | VTSVWTKGVTPPTDFRKIVDGN IAYYHAPYKAGQGWYDITKAFD GGDDLLCGAATAGNMLHWWFDQ NKEQIENYLKKHPEKQKINFNG EQMFDVKEAIDTKDSQTNSELF NYFKEKAFPYLSTKHLGVFPDH VIDMFINGYRLSLTNHGPTPVK RGSKDPRGGIFDAVFTRGDQSK LLTNRHDLKNKTLKEISDLIKQ ELTEGKALGISHTYANVRINHV INLWGADFDAEGNLEAIYVTDS DSNASIGMKKYFVGVNSNGKVA ISAKEIEEDNIGAQVLGLFTLS TGQDIWNQTN (SEQ ID NO: 800) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFRKIVDGNIAYYHAPYKAGQGWYD ITKAFDGGDDLLCGAATAGNMLHWWFDQNKEQIENYLK KHPEKQKINFNGEQMFDVKEAIDTKDSQTNSELFNYFK EKAFPYLSTKHLGVFPDHVIDMFINGYRLSLTNHGPTP VKRGSKDPRGGIFDAVFTRGDQSKLLTNRHDLKNKTLK EISDLIKQELTEGKALGISHTYANVRINHVINLWGADF DAEGNLEAIYVTDSDSNASIGMKKYFVGVNSNGKVAIS AKEIEEDNIGAQVLGLFTLSTGQDIWNQTNDKTHTCPP CPAPEAAGAPSVFLFPPKPKDTLMISRTPEVTCVVVDV SHEDPEVKFNWYVDGVEVHNAKTKPREEQQNSTYRVVS VLTVLHQDWLNGKEYKCKVSNKALKAPIEKTISKAKGQ PREPQVYTLPPSRDELTKNQVSLTCLVKGFYPSDIAVE WESNGQPENNYKTTPPVLDSDGSFFLYSKLTVDKSRWQ QGNVFSCSVMHEALHNHYTQKSLSLSPG (SEQ ID NO: 1070) |
| VRT-49 | VTSVWTKGVTPPTNFTYGEDVL HAPYVANQGWYDITKTFNGKDD LLCGAATAGNMLHWWFDQNKEQ IENYLKKHPEKQKINFNGEQMF DVKEAIDTKDSQLDSKLFEYFK | DKTHTCPPCPAPEAAG APSVFLFPPKPKDTLM ISRTPEVTCVVVDVSH EDPEVKFNWYVDGVEV HNAKTKPREEQQNSTY | VTSVWTKGVTPPTNFTYGEDVLHAPYVANQGWYDITKT FNGKDDLLCGAATAGNMLHWWFDQNKEQIENYLKKHPE KQKINFNGEQMFDVKEAIDTKDSQLDSKLFEYFKEKAF PYLSTKHLGVFPDHVIDMFINGYRLSLTNHGPTPVKRG SKDPRGGIFDAVFTRGDQSKLLTNRHDLKNKTLKEISD |

TABLE 7-continued

| ID | N-terminus Protease Moiety | C-terminus Fc Moiety | Full length Sequence |
|---|---|---|---|
|  | EKAFPYLSTKHLGVFPPDHVIDM FINGYRLSLTNHGPTPVKRGSK DPRGGIFDAVFTRGDQSKLLTN RHDLKNKTLKEISDLIKQELTE GKALGISHTYANVRINHVINLW GADFDAEGNLEAIYVTDSDSNA SIGMKKYFVGVNSNGKVAISAK EIEEDNIGAQVLGLFTLSTGQD IWNQTN (SEQ ID NO: 801) | RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | LIKQELTEGKALGISHTYANVRINHVINLWGADFDAEG NLEAIYVTDSDSNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1071) |
| VRT-50 | VTSVWTKGVTPPTDFIYGEDVL HAPYKAGQGWYDITKTFNGKDN LLCGAATAGNMLHWWFDQNKEQ IENYLKKHPEKQKIIFNNQELF DLKAAIDTKDSQLDSKLFEYFK EKAFPYLSTKHLGVFPPDHVIDM FINGYRLSLTNHGPTPVKRGSK DKRGGIFDAVFTRGVQSKLLTN RHDFKEKTLKEISDLIKQELTE GKALGISHTYANVRINHVINLW GADFDAEGNLEAIYVTDSDTNA SIGMKKYFVGVNSNGKVAISAK EIEEDNIGAQVLGLFTLSTGQD IWNQTN (SEQ ID NO: 802) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIYGEDVLHAPYKAGQGWYDITKT FNGKDNLLCGAATAGNMLHWWFDQNKEQIENYLKKHPE KQKIIFNNQELFDLKAAIDTKDSQLDSKLFEYFKEKAF PYLSTKHLGVFPPDHVIDMFINGYRLSLTNHGPTPVKRG SKDKRGGIFDAVFTRGVQSKLLTNRHDFKEKTLKEISD LIKQELTEGKALGISHTYANVRINHVINLWGADFDAEG NLEAIYVTDSDTNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1072) |
| VRT-51 | VTSVWTKGVTPPTDFIYGEDVL HAPYKAGQGWYDITKTFNGKDN LLCGAATAGNMLHWWFDQNKEQ IENYLKKHPEKQKIIFNNQELF DLKAAIDTKDSQLDSKLFEYFK EKAFPYLSTKHLGVFPPDHVIDM FINGYRLSLTNHGPTPVKRGSK DKRGGIFDAVFTRGVQSKLLIN RHDLKNKTLKEISDLIKQELTE GKALGISHTYANVRINHVINLW GADFDAEGNLEAIYVTDSDTNA SIGMKKYFVGVNSNGKVAISAK EIEEDNIGAQVLGLFTLSTGQD IWNQTN (SEQ ID NO: 803) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIYGEDVLHAPYKAGQGWYDITKT FNGKDNLLCGAATAGNMLHWWFDQNKEQIENYLKKHPE KQKIIFNNQELFDLKAAIDTKDSQLDSKLFEYFKEKAF PYLSTKHLGVFPPDHVIDMFINGYRLSLTNHGPTPVKRG SKDKRGGIFDAVFTRGVQSKLLTNRHDLKNKTLKEISD LIKQELTEGKALGISHTYANVRINHVINLWGADFDAEG NLEAIYVTDSDTNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1073) |
| VRT-52 | VTSVWTKGVTPPTDFIYGEDVL HAPYKAGQGWYDITKAFDGGDN LLCGAATAGNMLHWWFDQNKEQ IENYLKKHPEKQKIIFNNQELF DLKAAIDTKDSQTNSELFNYFK EKAFPYLSTKHLGVFPPDHVIDM FINGYRLSLTNHGPTPVKRGSK DKRGGIFDAVFTRGVQSKLLTN RHDLKNKTLKEISDLIKQELTE GKALGISHTYANVRINHVINLW GADFDAEGNLEAIYVTDSDTNA SIGMKKYFVGVNSNGKVAISAK EIEEDNIGAQVLGLFTLSTGQD IWNQTN (SEQ ID NO: 804) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIYGEDVLHAPYKAGQGWYDITKA FDGGDNLLCGAATAGNMLHWWFDQNKEQIENYLKKHPE KQKIIFNNQELFDLKAAIDTKDSQTNSELFNYFKEKAF PYLSTKHLGVFPPDHVIDMFINGYRLSLTNHGPTPVKRG SKDKRGGIFDAVFTRGVQSKLLTNRHDLKNKTLKEISD LIKQELTEGKALGISHTYANVRINHVINLWGADFDAEG NLEAIYVTDSDTNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1074) |
| VRT-53 | VTSVWTKGVTPPTNFTYGEDVL HAPYVANQGWYDITKTFNGKDN LLCGAATAGNMLHWWFDQNKEQ IENYLKKHPEKQKIIFNNQELF DLKAAIDTKDSQLDSKLFEYFK EKAFPYLSTKHLGVFPPDHVIDM FINGYRLSLTNHGPTPVKRGSK DKRGGIFDAVFTRGVQSKLLIN RHDLKNKTLKEISDLIKQELTE GKALGISHTYANVRINHVINLW | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE | VTSVWTKGVTPPTNFTYGEDVLHAPYVANQGWYDITKT FNGKDNLLCGAATAGNMLHWWFDQNKEQIENYLKKHPE KQKIIFNNQELFDLKAAIDTKDSQLDSKLFEYFKEKAF PYLSTKHLGVFPPDHVIDMFINGYRLSLTNHGPTPVKRG SKDKRGGIFDAVFTRGVQSKLLTNRHDLKNKTLKEISD LIKQELTEGKALGISHTYANVRINHVINLWGADFDAEG NLEAIYVTDSDTNASIGMKKYFVGVNSNGKVAISAKEI EEDNIGAQVLGLFTLSTGQDIWNQTNDKTHTCPPCPAP EAAGAPSVFLFPPKPKDTLMISRTPEVTCVVVDVSHED PEVKFNWYVDGVEVHNAKTKPREEQQNSTYRVVSVLTV |

TABLE 7-continued

| ID | N-terminus Protease Moiety | C-terminus Fc Moiety | Full length Sequence |
|---|---|---|---|
| | GADFDAEGNLEAIYVTDSDTNA SIGMKKYFVGVNSNGKVAISAK EIEEDNIGAQVLGLFTLSTGQD IWNQTN (SEQ ID NO: 805) | WESNGQPENNYKTTPP VLDSDGSFFLYSKLTV DKSRWQQGNVFSCSVM HEALHNHYTQKSLSLS PG (SEQ ID NO: 23) | LHQDWLNGKEYKCKVSNKALKAPIEKTISKAKGQPREP QVYTLPPSRDELTKNQVSLTCLVKGFYPSDIAVEWESN GQPENNYKTTPPVLDSDGSFFLYSKLTVDKSRWQQGNV FSCSVMHEALHNHYTQKSLSLSPG (SEQ ID NO: 1075) |
| VRT-54 | VTSVWTKGVTPPTDFIKGEDVF HAPYKAGQGWYDITKTFNGKDD LLCGAATAGNMLHWWFDQNKEY IEAYLKKHPEKQKIMFGDQELL DVRKAINTKGSQKNSELFNYFR DKAFPNLSARRLGVMPDLVLDM FINGYYLNVTKTQTTDVNRTYQ EKDKRGGIFDAVFTRGDQSKLL TSRHDFKEKGLKEISDLIKQEL TEGKALGLSHTYANVRINHVIN LWGADFDSDGNLKAIYVTDSDS NASIGMKKYFVGVNSAGKVAIS AKEIKEDNIGAQVLGLFTLSTG QDIWNQTN (SEQ ID NO: 806) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIKGEDVFHAPYKAGQGWYDITKT FNGKDDLLCGAATAGNMLHWWFDQNKEYIEAYLKKHPE KQKIMFGDQELLDVRKAINTKGSQKNSELFNYFRDKAF PNLSARRLGVMPDLVLDMFINGYYLNVTKTQTTDVNRT YQEKDKRGGIFDAVFTRGDQSKLLTSRHDFKEKGLKEI SDLIKQELTEGKALGLSHTYANVRINHVINLWGADFDS DGNLKAIYVTDSDSNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1076) |
| VRT-58 | VTSVWTKGVTPPTDFIKGEDVF HAPYKAGQGWYDITKTFNGKDN LLCGAATAGNMLHWWFDQNKEY IEAYLKKHPEKQKIIFNNQELF DLKAAINTKGSQKNSELFNYFR DKAFPNLSARRLGVFPDLVLDM FINGYYLNVTKTQTTDVNRTYQ EKDKRGGIFDAVFTRGVQSKLL TSRHDLKNKGLKEISDLIKQEL TEGKALGLSHTYANVRINHVIN LWGADFDSDGNLKAIYVTDSDS NASIGMKKYFVGVNSAGKVAIS AKEIKEDNIGAQVLGLFTLSTG QDIWNQTN (SEQ ID NO: 810) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPTDFIKGEDVFHAPYKAGQGWYDITKT FNGKDNLLCGAATAGNMLHWWFDQNKEYIEAYLKKHPE KQKIIFNNQELFDLKAAINTKGSQKNSELFNYFRDKAF PNLSARRLGVFPDLVLDMFINGYYLNVTKTQTTDVNRT YQEKDKRGGIFDAVFTRGVQSKLLTSRHDLKNKGLKEI SDLIKQELTEGKALGLSHTYANVRINHVINLWGADFDS DGNLKAIYVTDSDSNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1080) |
| VRT-59 | VTSVWTKGVTPPADFTQGEDVF HAPYVANQGWYDITKTFNGKDN LLCGAATAGNMLHWWFDQNKEY IEAYLKKHPEKQKIIFNNQELF DLKAAINTKGSQKNSELFNYFR DKAFPNLSARRLGVFPDLVLDM FINGYYLNVTKTQTTDVNRTYQ EKDKRGGIFDAVFTRGVQSKLL TSRHDLKNKGLKEISDLIKQEL TEGKALGLSHTYANVRINHVIN LWGADFDSDGNLKAIYVTDSDS NASIGMKKYFVGVNSAGKVAIS AKEIKEDNIGAQVLGLFTLSTG QDIWNQTN (SEQ ID NO: 811) | DKTHTCPPCPAPEAAG APSVFLFPPKPKDTLM ISRTPEVTCVVVDVSH EDPEVKFNWYVDGVEV HNAKTKPREEQQNSTY RVVSVLTVLHQDWLNG KEYKCKVSNKALKAPI EKTISKAKGQPREPQV YTLPPSRDELTKNQVS LTCLVKGFYPSDIAVE WESNGQPENNYKTTPP VLDSDGSFFLYSKLTV DKSRWQQGNVFSCSVM HEALHNHYTQKSLSLS PG (SEQ ID NO: 23) | VTSVWTKGVTPPADFTQGEDVFHAPYVANQGWYDITKT FNGKDNLLCGAATAGNMLHWWFDQNKEYIEAYLKKHPE KQKIIFNNQELFDLKAAINTKGSQKNSELFNYFRDKAF PNLSARRLGVFPDLVLDMFINGYYLNVTKTQTTDVNRT YQEKDKRGGIFDAVFTRGVQSKLLTSRHDLKNKGLKEI SDLIKQELTEGKALGLSHTYANVRINHVINLWGADFDS DGNLKAIYVTDSDSNASIGMKKYFVGVNSAGKVAISAK EIKEDNIGAQVLGLFTLSTGQDIWNQTNDKTHTCPPCP APEAAGAPSVFLFPPKPKDTLMISRTPEVTCVVVDVSH EDPEVKFNWYVDGVEVHNAKTKPREEQQNSTYRVVSVL TVLHQDWLNGKEYKCKVSNKALKAPIEKTISKAKGQPR EPQVYTLPPSRDELTKNQVSLTCLVKGFYPSDIAVEWE SNGQPENNYKTTPPVLDSDGSFFLYSKLTVDKSRWQQG NVFSCSVMHEALHNHYTQKSLSLSPG (SEQ ID NO: 1081) |

TABLE 8

| ID | N-terminus Fc Moiety | Linker | C-terminus Protease Moiety | Full length Sequence |
|---|---|---|---|---|
| VRT-60 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | VTSVWTKGVTPPANFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PNLSTKHLGVFPDHVIDMF INGYRLSLLNHGPTPVKEG SKDPRGGIFDAVFTRGDQS KLLTSRHDFKEKNLKEISD LIKKELTEGKALGLSHTYA INFNGEQMFDVKEAIDTKNHQLDSKLFEYFKE | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDDLLC GAATAGNMLHWWFDQNKDQIKRYLEEHPEKQK INFNGEQMFDVKEAIDTKNHQLDSKLFEYFKE |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | NVRINHVINLWGADFDSNG NLKAIYVTDSDSNASIGMK KYFVGVNSSGKVAISAKEI SRHDFKEKNLKEISDLIKKELTEGKALGLSHT KEDNIGAQVLGLFTLSTGQ DSWNQTN (SEQ ID NO: 812) | KAFPNLSTKHLGVFPDHVIDMFINGYRLSLLN HGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNASIGMKKYFVGVNSSGKVAISAKEIKEDNI GAQVLGLFTLSTGQDSWNQTN (SEQ ID NO: 1082) |
| VRT-61 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKT FNGKDDLLCGAATAGNMLH WWFDQNKDQIKRYLEEHPE KQKINFNGEQMFDVKEAID TKNHQLDSKLFDYFKEKAF PNLSTKHLGVFPDHVIDMF INGYRLSLLNHGPTPVKEG SKDPRGGIFDAVFTRGDQS KLLTSRHDFKEKNLKEISD LIKKELTEGKALGLSHTYA INFNGEQMFDVKEAIDTKNHQLDSKLFDYFKE NVRINHVINLWGADFDSNG NLKAIYVTDSDSNPSIGMK KYFVGVNSSGKVAISAKEI SRHDFKEKNLKEISDLIKKELTEGKALGLSHT KEDNIGAQVLGLFTLSTGQ DSWNQTN (SEQ ID NO: 813) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDDLLC GAATAGNMLHWWFDQNKDQIKRYLEEHPEKQK INFNGEQMFDVKEAIDTKNHQLDSKLFDYFKE KAFPNLSTKHLGVFPDHVIDMFINGYRLSLLN HGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNPSIGMKKYFVGVNSSGKVAISAKEIKEDNI GAQVLGLFTLSTGQDSWNQTN (SEQ ID NO: 1083) |
| VRT-62 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKL FNGKDDLLCGAATAGNMLH WWFDQNKDQIKRYLEEHPE KQKINFNGEQMFDVKEAID TKNHQLDSKLFDYFKEKAF PNLSTKHLGVFPDHVIDMF INGYRLSLLNHGPTPVKEG SKDPRGGIFDAVFTRGDQS KLLTSRHDFKEKNLKEISD LIKKELTEGKALGLSHTYA NGRINHVINLWGADFDSNG NLKAIYVTDSDSNPSIGMK KYFVGVNSSGKVAISAKEI KEDNIGAQVLGLFTLSTGQ DSWNQTN (SEQ ID NO: 814) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDDLLC GAATAGNMLHWWFDQNKDQIKRYLEEHPEKQK INFNGEQMFDVKEAIDTKNHQLDSKLFDYFKE KAFPNLSTKHLGVFPDHVIDMFINGYRLSLLN HGPTPVKEGSKDPRGGIFDAVFTRGDQSKLLT SRHDFKEKNLKEISDLIKKELTEGKALGLSHT YANGRINHVINLWGADFDSNGNLKAIYVTDSD SNPSIGMKKYFVGVNSSGKVAISAKEIKEDNI GAQVLGLFTLSTGQDSWNQIN (SEQ ID NO: 1084) |
| VRT-63 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFLEKAF PNLSTKHLGVFPDHVIDMF INGYRLSLLNHGPTPVKEG SKDPRGGIFDAVFTRGDQS KLLTSRHDFKEKNLKEISD LIKKELTEGKALGLSHTYA NVRINHVINLWGADFDSNG NLKAIYVTDSDSNASIGMK KYFVGVNSSGKVAISAKEI KEDNIGAQVLGLFTLSTGQ DSWNQTN (SEQ ID NO: 815) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDDLLC GAATAGNMLHWWFDQNKDQIKRYLEEHPEKQK INFNGEQMFDVKEAIDTKNHQLDSKLFEYFLE KAFPNLSTKHLGVFPDHVIDMFINGYRLSLLN HGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNASIGMKKYFVGVNSSGKVAISAKEIKEDNI GAQVLGLFTLSTGQDSWNQTN (SEQ ID NO: 1085) |
| VRT-64 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | VTSVWTKGVTPPANFTQGE DVFHAPYVANQGWYDITKL FNGKDDLLCGAATAGNMLH WWFDQNKDQIKRYLEEHPE KQKINFNGEQMFDVKEAID TKNHQLDSKLFEYFLEKAF PNLSTKHLGVFPDHVIDMF INGYRLSLLNHGPTPVKEG SKDPRGGIFDAVFTRGDQS KLLTSRHDFKEKNLKEISD LIKKELTEGKALGLSHTYA NGRINHVINLWGADFDSNG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDDLLC GAATAGNMLHWWFDQNKDQIKRYLEEHPEKQK INFNGEQMFDVKEAIDTKNHQLDSKLFEYFLE KAFPNLSTKHLGVFPDHVIDMFINGYRLSLLN |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | NLKAIAVTDSDSNASIGMK KYFVGVNSSGKVAISAKEI SRHDFKEKNLKEISDLIKKELTEGKALGLSHT KEDNIGAQVLGLFTLSTGQ YANGRINHVINLWGADFDSNGNLKAIAVTDSD DSWNQTN (SEQ ID NO: 816) | |
| VRT-65 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKL FNGKDDLLCGAATAGNMLH WWFDQNKDQIKRYLEEHPE KQKINFNGEQMFDVKEAID TKNHQLDSKLFDYFKEKAF PYLSTKHLGVFPDHVIDMF INGYRLSLTNHGPTPVKEG SKDPRGGIFDAVFTRGDQS KLLTSRHDFKEKNLKEISD LIKKELTEGKALGLSHTYA NVRINHVINLWGADFDSNG NLKAIYVTDSDSNPSIGMK KYFVGVNSSGKVAISAKEI KEDNIGAQVLGLFTLSTGQ DSWNQIN (SEQ ID NO: 817) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDDLLC GAATAGNMLHWWFDQNKDQIKRYLEEHPEKQK INFNGEQMFDVKEAIDTKNHQLDSKLFDYFKE KAFPYLSTKHLGVFPDHVIDMFINGYRLSLIN NLKAIYVTDSDSNPSIGMKHGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNPSIGMKKYFVGVNSSGKVAISAKEIKEDNI GAQVLGLFTLSTGQDSWNQTN (SEQ ID NO: 1087) |
| VRT-66 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKL FNGKDDLLCGAATAGNMLH WWFDQNKDQIKRYLEEHPE KEYKCKVSNKALKAPIEKTISKAKGQPREPQV KQKINFNGEQMFDVKEAID TKNHQLDSKLFEYFLEKAF PYLSTKHLGVFPDHVIDMF INGYRLSLTNHGPTPVKEG SKDPRGGIFDAVFTRGDQS KLLTSRHDFKEKNLKEISD LIKKELTEGKALGLSHTYA INFNGEQMFDVKEAIDTKNHQLDSKLFEYFLE NVRINHVINLWGADFDSNG NLKAIAVTDSDSNASIGMK KYFVGVNSSGKVAISAKEI KEDNIGAQVLGLFTLSTGQ DSWNQTN (SEQ ID NO: 818) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDDLLC GAATAGNMLHWWFDQNKDQIKRYLEEHPEKQK INFNGEQMFDVKEAIDTKNHQLDSKLFEYFLE KAFPYLSTKHLGVFPDHVIDMFINGYRLSLIN NLKAIAVTDSDSNASIGMKHGPTPVKEGSKDPRGGIFDAVFTRGDQSKLLT SRHDFKEKNLKEISDLIKKELTEGKALGLSHT YANVRINHVINLWGADFDSNGNLKAIAVTDSD SNASIGMKKYFVGVNSSGKVAISAKEIKEDNI GAQVLGLFTLSTGQDSWNQTN (SEQ ID NO: 1088) |
| VRT-67 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFEYFKEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVRINHVINLWGADFDAEG NLEAIYVTDSDSNASIGMK KYFVGVNSSGKVAISAKEI EEDNIGAQVLGLFTLSTGQ DIWNQTN (SEQ ID NO: 819) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK INFNGEQMFDVKEAIDTKDSQLDSKLFEYFKE KAFPNLSTKHLGVFPDHVIDMFINGYRLSLLN NLEAIYVTDSDSNASIGMKHGPTPVKRGSKDPRGGIFDAVFTRGDQSKLLT NRHDFKEKTLKEISDLIKQELTEGKALGISHT YANVRINHVINLWGADFDAEGNLKAIAVTDSD SNASIGMKKYFVGVNSSGKVAISAKEIEEDNI GAQVLGLFTLSTGQDIWNQTN (SEQ ID NO: 1089) |
| VRT-68 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFDYFKEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVRINHVINLWGADFDAEG NLEAIYVTDSDSNPSIGMK | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK INFNGEQMFDVKEAIDTKDSQLDSKLFDYFKE KAFPNLSTKHLGVFPDHVIDMFINGYRLSLLN NLEAIYVTDSDSNPSIGMKHGPTPVKRGSKDPRGGIFDAVFTRGDQSKLLT |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | KYFVGVNSSGKVAISAKEI EEDNIGAQVLGLFTLSTGQ DIWNQTN (SEQ ID NO: 820) | NRHDFKEKTLKEISDLIKQELTEGKALGISHT YANVRINHVINLWGADFDAEGNLEAIYVTDSD SNPSIGMKKYFVGVNSSGKVAISAKEIEEDNI GAQVLGLFTLSTGQDIWNQTN (SEQ ID NO: 1090) |
| VRT-69 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDDLLCGAATAGNMLH WWFDQNKEQIENYLKKHPE KQKINFNGEQMFDVKEAID TKDSQLDSKLFDYFKEKAF PNLSTKHLGVFPDHVIDMF INGYRLSLLNHGPTPVKRG PGGGGSGGGGSGGGGSGVTSVWTKGVTPPTNF SKDPRGGIFDAVFTRGDQS TYGEDVLHAPYVANQGWYDITKLFNGKDDLLC KLLTNRHDFKEKTLKEISD GAATAGNMLHWWFDQNKEQIENYLKKHPEKQK LIKQELTEGKALGISHTYA INFNGEQMFDVKEAIDTKDSQLDSKLFDYFKE NGRINHVINLWGADFDAEG KAFPNLSTKHLGVFPDHVIDMFINGYRLSLLN NLEAIYVTDSDSNPSIGMK HGPTPVKRGSKDPRGGIFDAVFTRGDQSKLLT KYFVGVNSSGKVAISAKEI NRHDFKEKTLKEISDLIKQELTEGKALGISHT EEDNIGAQVLGLFTLSTGQ YANGRINHVINLWGADFDAEGNLEAIYVTDSD DIWNQTN (SEQ ID NO: 821) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDDLLC GAATAGNMLHWWFDQNKEQIENYLKKHPEKQK INFNGEQMFDVKEAIDTKDSQLDSKLFDYFKE KAFPNLSTKHLGVFPDHVIDMFINGYRLSLLN HGPTPVKRGSKDPRGGIFDAVFTRGDQSKLLT NRHDFKEKTLKEISDLIKQELTEGKALGISHT YAINFNGEQMFDVKEAIDTKDSQLDSKLFDYFKE NGRINHVINLWGADFDAEGNLEAIYVTDSD SNPSIGMKKYFVGVNSSGKVAISAKEIEEDNI GAQVLGLFTLSTGQDIWNQTN (SEQ ID NO: 1091) |
| VRT-70 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVRINHVINLWGADFDAEG NLEAIAVTDSDSNASIGMK KYFVGVNSSGKVAISAKEI EEDNIGAQVLGLFTLSTGQ DIWNQTN (SEQ ID NO: 822) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK INFNGEQMFDVKEAIDTKDSQLDSKLFEYFLE KAFPNLSTKHLGVFPDHVIDMFINGYRLSLLN HGPTPVKRGSKDPRGGIFDAVFTRGDQSKLLT NRHDFKEKTLKEISDLIKQELTEGKALGISHT YANVRINHVINLWGADFDAEGNLEAIAVTDSD SNASIGMKKYFVGVNSSGKVAISAKEIEEDNI GAQVLGLFTLSTGQDIWNQTN (SEQ ID NO: 1092) |
| VRT-71 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA INFNGEQMFDVKEAIDTKDSQLDSKLFEYFLE NGRINHVINLWGADFDAEG KAFPNLSTKHLGVFPDHVIDMFINGYRLSLLN NLEAIAVTDSDSNASIGMK HGPTPVKRGSKDPRGGIFDAVFTRGDQSKLLT KYFVGVNSSGKVAISAKEI NRHDFKEKTLKEISDLIKQELTEGKALGISHT EEDNIGAQVLGLFTLSTGQ YANGRINHVINLWGADFDAEGNLEAIAVTDSD DIWNQTN (SEQ ID NO: 823) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDDLLC GAATAGNMLHWWFDQNKEQIENYLKKHPEKQK INFNGEQMFDVKEAIDTKDSQLDSKLFEYFLE KAFPNLSTKHLGVFPDHVIDMFINGYRLSLLN HGPTPVKRGSKDPRGGIFDAVFTRGDQSKLLT NRHDFKEKTLKEISDLIKQELTEGKALGISHT YANGRINHVINLWGADFDAEGNLEAIAVTDSD SNASIGMKKYFVGVNSSGKVAISAKEIEEDNI GAQVLGLFTLSTGQDIWNQTN (SEQ ID NO: 1093) |
| VRT-72 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVRINHVINLWGADFDAEG NLEAIAVTDSDSNKSIGMK KYFVGVNSDGKVAISAKEI | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK INFNGEQMFDVKEAIDTKDSQLDSKLFEYFLE KAFPNLSTKHLGVFPDHVIDMFINGYRLSLLN HGPTPVKRGSKDPRGGIFDAVFTRGDQSKLLT NRHDFKEKTLKEISDLIKQELTEGKALGISHT |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | EEDNIGAQVLGLFTLSTGQ DIWNQTN (SEQ ID NO: 824) | YANVRINHVINLWGADFDAEGNLEAIYVTDSD SNKSIGMKKYFVGVNSDGKVAISAKEIEEDNI GAQVLGLFTLSTGQDIWNQTN (SEQ ID NO: 1094) |
| VRT-73 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVRINHVINLWGADFDAEG KYPVGVNSNGKVAISAKEI EEDNIGAQVLGLFTLSTGQ DIWNQTN (SEQ ID NO: 825) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFNGEQMFDVKEAID YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK LIKQELTEGKALGISHTYA INFNGEQMFDVKEAIDTKDSQLDSKLFEYFLE KAFPNLSTKHLGVFPDHVIDMFINGYRLSLLN HGPTPVKRGSKDPRGGIFDAVFTRGDQSKLLT KYPVGVNSNGKVAISAKEI NRHDFKEKTLKEISDLIKQELTEGKALGISHT YANVRINHVINLWGADFDAEGNLEAIYVTDSD SNKSIGMKKYPVGVNSNGKVAISAKEIEEDNI GAQVLGLFTLSTGQDIWNQTN (SEQ ID NO: 1095) |
| VRT-74 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVGINHVINLWGADFDAEG NLEAIAVTDSDSNASIGMK KYFVGVNSSGKVAISAKEI EEDNIGAQVLGLFTLSTGQ DIWNQTN (SEQ ID NO: 826) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFNGEQMFDVKEAID YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDDLLC GAATAGNMLHWWFDQNKEQIENYLKKHPEKQK LIKQELTEGKALGISHTYA INFNGEQMFDVKEAIDTKDSQLDSKLFEYFLE KAFPNLSTKHLGVFPDHVIDMFINGYRLSLLN NLEAIAVTDSDSNASIGMK HGPTPVKRGSKDPRGGIFDAVFTRGDQSKLLT KYFVGVNSSGKVAISAKEI NRHDFKEKTLKEISDLIKQELTEGKALGISHT YANVGINHVINLWGADFDAEGNLEAIAVTDSD SNASIGMKKYFVGVNSSGKVAISAKEIEEDNI GAQVLGLFTLSTGQDIWNQTN (SEQ ID NO: 1096) |
| VRT-75 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDFKEKTLKEISD LIKQELTEGKALGISHTYA NVGINHVINLWGADFDAEG NLEAIAVTDSDSNASIGMK KYFVGVNSSGKVAISAKEI EEDNIGAQVLGLFTLSTGQ DIWNQTN (SEQ ID NO: 827) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFNGEQMFDVKEAID YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDDLLC GAATAGNMLHWWFDQNKEQIENYLKKHPEKQK LIKQELTEGKALGISHTYA INFNGEQMFDVKEAIDTKDSQLDSKLFEYFLE KAFPNLSTKHLGVFPDHVIDMFINGYRLSLLN NLEAIAVTDSDSNASIGMK HGPTPVKRGSKDPRGGIFDAVFTRGDQSKLLT KYFVGVNSSGKVAISAKEI NRHDFKEKTLKEISDLIKQELTEGKALGISHT YANVGINHVINLWGADFDAEGNLEAIAVTDSD SNASIGMKKYFVGVNSSGKVAISAKEIEEDNI GAQVLGLFTLSTGQDIWNQTN (SEQ ID NO: 1097) |
| VRT-76 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGGSGG GGSGGGG SG (SEQ ID NO: 1020) | VTSVWTKGVTPPTNFTYGE DVLHAPYVANQGWYDITKL FNGKDDLLCGAATAGNMLH WWFDQNKEQIENYLKKHPE KQKINFNGEQMFDVKEAID TKDSQLDSKLFDYFKEKAF PYLSTKHLGVFPDHVIDMF INGYRLSLTNHGPTPVKRG SKDPRGGIFDAVFTRGDQS KLLTNRHDFKEKTLKEISD LIKQELTEGKALGISHTYA NVRINHVINLWGADFDAEG NLEAIYVTDSDSNPSIGMK KYFVGVNSSGKVAISAKEI EEDNIGAQVLGLFTLSTGQ | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFNGEQMFDVKEAID YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDDLLC GAATAGNMLHWWFDQNKEQIENYLKKHPEKQK LIKQELTEGKALGISHTYA INFNGEQMFDVKEAIDTKDSQLDSKLFDYFKE KAFPYLSTKHLGVFPDHVIDMFINGYRLSLTN NLEAIYVTDSDSNPSIGMK HGPTPVKRGSKDPRGGIFDAVFTRGDQSKLLT KYFVGVNSSGKVAISAKEI NRHDFKEKTLKEISDLIKQELTEGKALGISHT YANVRINHVINLWGADFDAEGNLEAIYVTDSD |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | DIWNQTN (SEQ ID NO: 828) | SNPSIGMKKYFVGVNSSGKVAISAKEIEEDNI GAQVLGLFTLSTGQDIWNQTN (SEQ ID NO: 1098) |
| VRT-77 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDDLLCGAATAGNMLH WWFDQNKEQIENYLKKHPE KQKINFNGEQMFDVKEAID TKDSQLDSKLFEYFLEKAF WESNGQPENNYKTTPPVLDSDGSFFLYSKLTV PYLSTKHLGVFPDHVIDMF INGYRLSLTNHGPTPVKRG SKDPRGGIFDAVFTRGDQS KLLTNRHDFKEKTLKEISD GAATAGNMLHWWFDQNKEQIENYLKKHPEKQK LIKQELTEGKALGISHTYA NVRINHVINLWGADFDAEG NLEAIAVTDSDSNASIGMK KYFVGVNSSGKVAISAKEI NRHDFKEKTLKEISDLIKQELTEGKALGISHT EEDNIGAQVLGLFTLSTGQ DIWNQTN (SEQ ID NO: 829) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDDLLC GAATAGNMLHWWFDQNKEQIENYLKKHPEKQK INFNGEQMFDVKEAIDTKDSQLDSKLFEYFLE KAFPYLSTKHLGVFPDHVIDMFINGYRLSLIN HGPTPVKRGSKDPRGGIFDAVFTRGDQSKLLT NRHDFKEKTLKEISDLIKQELTEGKALGISHT YANVRINHVINLWGADFDAEGNLEAIAVTDSD SNASIGMKKYFVGVNSSGKVAISAKEIEEDNI GAQVLGLFTLSTGQDIWNQTN (SEQ ID NO: 1099) |
| VRT-78 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDNLLCGAATAGNMLH WWFDQNKEQIENYLKKHPE KQKINFNGEQLFDVKEAID TKDSQLDSKLFEYFKEKAF WESNGQPENNYKTTPPVLDSDGSFFLYSKLTV PNLSTKHLGVFPDHVIDMF INGYRLSLLNHGPTPVKRG SKDKRGGIFDAVFTRGVQS KLLTNRHDFKEKTLKEISD GAATAGNMLHWWFDQNKEQIENYLKKHPEKQK LIKQELTEGKALGISHTYA INFNGEQLFDVKEAIDTKDSQLDSKLFEYFKE NVRINHVINLWGADFDAEG KAFPNLSTKHLGVFPDHVIDMFINGYRLSLLN NLEAIYVTDSDTNASIGMK HGPTPVKRGSKDKRGGIFDAVFTRGVQSKLLT KYFVGVNSSGKVAISAKEI NRHDFKEKTLKEISDLIKQELTEGKALGISHT EEDNIGAQVLGLFTLSTGQ DIWNQTN (SEQ ID NO: 830) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDNLLC GAATAGNMLHWWFDQNKEQIENYLKKHPEKQK INFNGEQLFDVKEAIDTKDSQLDSKLFEYFKE KAFPNLSTKHLGVFPDHVIDMFINGYRLSLLN HGPTPVKRGSKDKRGGIFDAVFTRGVQSKLLT NRHDFKEKTLKEISDLIKQELTEGKALGISHT YANVRINHVINLWGADFDAEGNLEAIYVTDSD TNASIGMKKYFVGVNSSGKVAISAKEIEEDNI GAQVLGLFTLSTGQDIWNQTN (SEQ ID NO: 1100) |
| VRT-79 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDNLLCGAATAGNMLH WWFDQNKEQIENYLKKHPE KQKINFNGEQLFDVKEAID TKDSQLDSKLFDYFKEKAF WESNGQPENNYKTTPPVLDSDGSFFLYSKLTV PNLSTKHLGVFPDHVIDMF INGYRLSLLNHGPTPVKRG SKDKRGGIFDAVFTRGVQS TYGEDVLHAPYVANQGWYDITKTFNGKDNLLC KLLTNRHDFKEKTLKEISD GAATAGNMLHWWFDQNKEQIENYLKKHPEKQK LIKQELTEGKALGISHTYA INFNGEQLFDVKEAIDTKDSQLDSKLFDYFKE NVRINHVINLWGADFDAEG KAFPNLSTKHLGVFPDHVIDMFINGYRLSLLN NLEAIYVTDSDTNPSIGMK HGPTPVKRGSKDKRGGIFDAVFTRGVQSKLLT KYFVGVNSSGKVAISAKEI NRHDFKEKTLKEISDLIKQELTEGKALGISHT EEDNIGAQVLGLFTLSTGQ YANVRINHVINLWGADFDAEGNLEAIYVTDSD DIWNQTN (SEQ ID NO: 831) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TNPSIGMKKYFVGVNSSGKVAISAKEIEEDNI GAQVLGLFTLSTGQDIWNQTN (SEQ ID NO: 1101) |
| VRT-80 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | VTSVWTKGVTPPTNFTYGE DVLHAPYVANQGWYDITKL FNGKDDNLLCGAATAGNMLH WWFDQNKEQIENYLKKHPE KQKINFNGEQLFDVKEAID TKDSQLDSKLFDYFKEKAF PNLSTKHLGVFPDHVIDMF INGYRLSLLNHGPTPVKRG SKDKRGGIFDAVFTRGVQS KLLTNRHDFKEKTLKEISD GAATAGNMLHWWFDQNKEQIENYLKKHPEKQK LIKQELTEGKALGISHTYA INFNGEQLFDVKEAIDTKDSQLDSKLFDYFKE NGRINHVINLWGADFDAEG KAFPNLSTKHLGVFPDHVIDMFINGYRLSLLN NLEAIYVTDSDINPSIGMK HGPTPVKRGSKDKRGGIFDAVFTRGVQSKLLT | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDNLLC GAATAGNMLHWWFDQNKEQIENYLKKHPEKQK INFNGEQLFDVKEAIDTKDSQLDSKLFDYFKE KAFPNLSTKHLGVFPDHVIDMFINGYRLSLLN |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | KYFVGVNSSGKVAISAKEI EEDNIGAQVLGLFTLSTGQ DIWNQTN (SEQ ID NO: 832) | NRHDFKEKTLKEISDLIKQELTEGKALGISHT YANGRINHVINLWGADFDAEGNLEAIYVTDSD TNPSIGMKKYFVGVNSSGKVAISAKEIEEDNI GAQVLGLFTLSTGQDIWNQTN (SEQ ID NO: 1102) |
| VRT-81 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDNLLCGAATAGNMLH WWFDQNKEQIENYLKKHPE KQKINFNGEQLEDVKEAID TKDSQLDSKLFEYFLEKAF PNLSTKHLGVFPDHVIDMF INGYRLSLLNHGPTPVKRG PGGGGSGGGGSGGGGSGVTSVWTKGVTPPTNF SKDKRGGIFDAVFTRGVQS TYGEDVLHAPYVANQGWYDITKTFNGKDNLLC KLLTNRHDFKEKTLKEISD GAATAGNMLHWWFDQNKEQIENYLKKHPEKQK LIKQELTEGKALGISHTYA INFNGEQLFDVKEAIDTKDSQLDSKLFEYFLE NVRINHVINLWGADFDAEG KAFPNLSTKHLGVFPDHVIDMFINGYRLSLLN NLEAIAVTDSDTNASIGMK HGPTPVKRGSKDKRGGIFDAVFTRGVQSKLLT KYFVGVNSSGKVAISAKEI NRHDFKEKTLKEISDLIKQELTEGKALGISHT EEDNIGAQVLGLFTLSTGQ YANVRINHVINLWGADFDAEGNLEAIAVTDSD DIWNQTN (SEQ ID NO: 833) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFNGEQLEDVKEAID YTLPPSRDELTKNQVSLTCLVKGFYPSDIAVE TKDSQLDSKLFEYFLEKAF WESNGQPENNYKTTPPVLDSDGSFFLYSKLTV PNLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTNF SKDKRGGIFDAVFTRGVQS TYGEDVLHAPYVANQGWYDITKTFNGKDNLLC KLLTNRHDFKEKTLKEISD GAATAGNMLHWWFDQNKEQIENYLKKHPEKQK LIKQELTEGKALGISHTYA INFNGEQLFDVKEAIDTKDSQLDSKLFEYFLE NVRINHVINLWGADFDAEG KAFPNLSTKHLGVFPDHVIDMFINGYRLSLLN NLEAIAVTDSDTNASIGMK HGPTPVKRGSKDKRGGIFDAVFTRGVQSKLLT KYFVGVNSSGKVAISAKEI NRHDFKEKTLKEISDLIKQELTEGKALGISHT EEDNIGAQVLGLFTLSTGQ YANVRINHVINLWGADFDAEGNLEAIAVTDSD DIWNQTN (SEQ ID NO: 833) TNASIGMKKYFVGVNSSGKVAISAKEIEEDNI GAQVLGLFTLSTGQDIWNQTN (SEQ ID NO: 1103) |
| VRT-82 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDNLLCGAATAGNMLH WWFDQNKEQIENYLKKHPE KQKINFNGEQLEDVKEAID TKDSQLDSKLFEYFLEKAF PNLSTKHLGVFPDHVIDMF INGYRLSLLNHGPTPVKRG SKDKRGGIFDAVFTRGVQS KLLTNRHDFKEKTLKEISD LIKQELTEGKALGISHTYA NGRINHVINLWGADFDAEG NLEAIAVTDSDTNASIGMK KYFVGVNSSGKVAISAKEI EEDNIGAQVLGLFTLSTGQ DIWNQTN (SEQ ID NO: 834) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDNLLC GAATAGNMLHWWFDQNKEQIENYLKKHPEKQK INFNGEQLEDVKEAIDTKDSQLDSKLFEYFLE KAFPNLSTKHLGVFPDHVIDMFINGYRLSLLN HGPTPVKRGSKDKRGGIFDAVFTRGVQSKLLT NRHDFKEKTLKEISDLIKQELTEGKALGISHT YANGRINHVINLWGADFDAEGNLEAIAVTDSD TNASIGMKKYFVGVNSSGKVAISAKEIEEDNI GAQVLGLFTLSTGQDIWNQTN (SEQ ID NO: 1104) |
| VRT-83 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDNLLCGAATAGNMLH WWFDQNKEQIENYLKKHPE KQKINFNGEQLFDVKEAID TKDSQLDSKLFDYFKEKAF PYLSTKHLGVFPDHVIDMF INGYRLSLTNHGPTPVKRG SKDKRGGIFDAVFTRGVQS KLLTNRHDFKEKTLKEISD LIKQELTEGKALGISHTYA NVRINHVINLWGADFDAEG NLEAIYVTDSDTNPSIGMK KYFVGVNSSGKVAISAKEI EEDNIGAQVLGLFTLSTGQ DIWNQTN (SEQ ID NO: 835) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDNLLC GAATAGNMLHWWFDQNKEQIENYLKKHPEKQK INFNGEQLFDVKEAIDTKDSQLDSKLFEYFLE KAFPYLSTKHLGVFPDHVIDMFINGYRLSLTN HGPTPVKRGSKDKRGGIFDAVFTRGVQSKLLT NRHDFKEKTLKEISDLIKQELTEGKALGISHT YANVRINHVINLWGADFDAEGNLEAIYVTDSD TNPSIGMKKYFVGVNSSGKVAISAKEIEEDNI GAQVLGLFTLSTGQDIWNQTN (SEQ ID NO: 1105) |
| VRT-84 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGGSGG GGSGGGG SG (SEQ ID NO: 1020) | VTSVWTKGVTPPTNFTYGE DVLHAPYVANQGWYDITKL FNGKDNLLCGAATAGNMLH WWFDQNKEQIENYLKKHPE KQKINFNGEQLFDVKEAID TKDSQLDSKLFEYFLEKAF PYLSTKHLGVFPDHVIDMF INGYRLSLTNHGPTPVKRG SKDKRGGIFDAVFTRGVQS KLLTNRHDFKEKTLKEISD LIKQELTEGKALGISHTYA NVRINHVINLWGADFDAEG KAFPYLSTKHLGVFPDHVIDMFINGYRLSLTN NLEAIAVTDSDTNASIGMK HGPTPVKRGSKDKRGGIFDAVFTRGVQSKLLT KYFVGVNSSGKVAISAKEI NRHDFKEKTLKEISDLIKQELTEGKALGISHT | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDNLLC GAATAGNMLHWWFDQNKEQIENYLKKHPEKQK INFNGEQLFDVKEAIDTKDSQLDSKLFEYFLE KAFPYLSTKHLGVFPDHVIDMFINGYRLSLTN HGPTPVKRGSKDKRGGIFDAVFTRGVQSKLLT NRHDFKEKTLKEISDLIKQELTEGKALGISHT |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | EEDNIGAQVLGLFTLSTGQ DIWNQTN (SEQ ID NO: 836) | YANVRINHVINLWGADFDAEGNLEAIAVTDSD TNASIGMKKYFVGVNSSGKVAISAKEIEEDNI GAQVLGLFTLSTGQDIWNQTN (SEQ ID NO: 1106) |
| VRT-85 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPTDFIYGE DVLHAPYKAGQGWYDITKT FNGKDDLLCGAATAGNMLH WWFDQNKEQIENYLKKHPE KQKINFNGEQMFDVKEAID TKDSQLDSKLFEYFKEKAF WESNGQPENNYKTTPPVLDSDGSFFLYSKLTV PNLSTKHLGVFPDHVIDMF INGYRLSLLNHGPTPVKRG SKDPRGGIFDAVFTRGDQS KLLTNRHDLKNKTLKEISD LIKQELTEGKALGISHTYA NVRINHVINLWGADFDAEG NLEAIYVTDSDSNASIGMK HGPTPVKRGSKDPRGGIFDAVFTRGDQSKLLT KYFVGVNSSGKVAISAKEI EEDNIGAQVLGLFTLSTGQ DIWNQTN (SEQ ID NO: 837) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDDLLC GAATAGNMLHWWFDQNKEQIENYLKKHPEKQK INFNGEQMFDVKEAIDTKDSQLDSKLFEYFKE KAFPNLSTKHLGVFPDHVIDMFINGYRLSLLN NLEAIYVTDSDSNASIGMK HGPTPVKRGSKDPRGGIFDAVFTRGDQSKLLT NRHDLKNKTLKEISDLIKQELTEGKALGISHT YANVRINHVINLWGADFDAEGNLEAIYVTDSD SNASIGMKKYFVGVNSSGKVAISAKEIEEDNI GAQVLGLFTLSTGQDIWNQTN (SEQ ID NO: 1107) |
| VRT-86 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPTDFIYGE DVLHAPYKAGQGWYDITKT FNGKDDLLCGAATAGNMLH WWFDQNKEQIENYLKKHPE KQKINFNGEQMFDVKEAID TKDSQLDSKLFDYFKEKAF PNLSTKHLGVFPDHVIDMF INGYRLSLLNHGPTPVKRG SKDPRGGIFDAVFTRGDQS KLLTNRHDLKNKTLKEISD LIKQELTEGKALGISHTYA NVRINHVINLWGADFDAEG NLEAIYVTDSDSNPSIGMK KYFVGVNSSGKVAISAKEI EEDNIGAQVLGLFTLSTGQ DIWNQTN (SEQ ID NO: 838) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDDLLC GAATAGNMLHWWFDQNKEQIENYLKKHPEKQK INFNGEQMFDVKEAIDTKDSQLDSKLFDYFKE KAFPNLSTKHLGVFPDHVIDMFINGYRLSLLN HGPTPVKRGSKDPRGGIFDAVFTRGDQSKLLT NRHDLKNKTLKEISDLIKQELTEGKALGISHT YANVRINHVINLWGADFDAEGNLEAIYVTDSD SNPSIGMKKYFVGVNSSGKVAISAKEIEEDNI GAQVLGLFTLSTGQDIWNQTN (SEQ ID NO: 1108) |
| VRT-87 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPTDFIYGE DVLHAPYKAGQGWYDITKL FNGKDDLLCGAATAGNMLH WWFDQNKEQIENYLKKHPE KQKINFNGEQMFDVKEAID TKDSQLDSKLFDYFKEKAF PNLSTKHLGVFPDHVIDMF INGYRLSLLNHGPTPVKRG SKDPRGGIFDAVFTRGDQS KLLTNRHDLKNKTLKEISD LIKQELTEGKALGISHTYA NGRINHVINLWGADFDAEG NLEAIYVTDSDSNPSIGMK KYFVGVNSSGKVAISAKEI EEDNIGAQVLGLFTLSTGQ DIWNQTN (SEQ ID NO: 839) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDDLLC GAATAGNMLHWWFDQNKEQIENYLKKHPEKQK INFNGEQMFDVKEAIDTKDSQLDSKLFDYFKE KAFPNLSTKHLGVFPDHVIDMFINGYRLSLLN HGPTPVKRGSKDPRGGIFDAVFTRGDQSKLLT NRHDLKNKTLKEISDLIKQELTEGKALGISHT YANGRINHVINLWGADFDAEGNLEAIYVTDSD SNPSIGMKKYFVGVNSSGKVAISAKEIEEDNI GAQVLGLFTLSTGQDIWNQTN (SEQ ID NO: 1109) |
| VRT-88 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGGSGG GSGGGGG SG (SEQ ID NO: 1020) | VTSVWTKGVTPPTDFIYGE DVLHAPYKAGQGWYDITKT FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDLKNKTLKEISD LIKQELTEGKALGISHTYA NVRINHVINLWGADFDAEG NLEAIAVTDSDSNASIGMK KYFVGVNSSGKVAISAKEI EEDNIGAQVLGLFTLSTGQ | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDDLLC GAATAGNMLHWWFDQNKEQIENYLKKHPEKQK INFNGEQMFDVKEAIDTKDSQLDSKLFEYFLE KAFPNLSTKHLGVFPDHVIDMFINGYRLSLLN NLEAIAVTDSDSNASIGMK HGPTPVKRGSKDPRGGIFDAVFTRGDQSKLLT NRHDLKNKTLKEISDLIKQELTEGKALGISHT YANVRINHVINLWGADFDAEGNLEAIAVTDSD |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | DIWQNTN (SEQ ID NO: 840) | SNASIGMKKYFVGVNSSGKVAISAKEIEEDNI GAQVLGLFTLSTGQDIWQNTN (SEQ ID NO: 1110) |
| VRT-89 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDDLLCGAATAGNMLH WWFDQNKEQIENYLKKHPE KQKINFNGEQMFDVKEAID TKDSQLDSKLFEYFLEKAF PNLSTKHLGVFPDHVIDMF INGYRLSLLNHGPTPVKRG SKDPRGGIFDAVFTRGDQS KLLTNRHDLKNKTLKEISD LIKQELTEGKALGISHTYA NGRINHVINLWGADFDAEG NLEAIAVTDSDSNASIGMK KYFVGVNSSGKVAISAKEI EEDNIGAQVLGLFTLSTGQ DIWQNTN (SEQ ID NO: 841) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDDLLC GAATAGNMLHWWFDQNKEQIENYLKKHPEKQK INFNGEQMFDVKEAIDTKDSQLDSKLFEYFLE KAFPNLSTKHLGVFPDHVIDMFINGYRLSLLN HGPTPVKRGSKDPRGGIFDAVFTRGDQSKLLT NRHDLKNKTLKEISDLIKQELTEGKALGISHT YANGRINHVINLWGADFDAEGNLEAIAVTDSD SNASIGMKKYFVGVNSSGKVAISAKEIEEDNI GAQVLGLFTLSTGQDIWQNTN (SEQ ID NO: 1111) |
| VRT-90 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDDLLCGAATAGNMLH WWFDQNKEQIENYLKKHPE KQKINFNGEQMFDVKEAID TKDSQLDSKLFDYFKEKAF PYLSTKHLGVFPDHVIDMF INGYRLSLTNHGPTPVKRG SKDPRGGIFDAVFTRGDQS KLLTNRHDLKNKTLKEISD LIKQELTEGKALGISHTYA NVRINHVINLWGADFDAEG NLEAIYVTDSDSNPSIGMK KYFVGVNSSGKVAISAKEI EEDNIGAQVLGLFTLSTGQ DIWQNTN (SEQ ID NO: 842) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDDLLC GAATAGNMLHWWFDQNKEQIENYLKKHPEKQK INFNGEQMFDVKEAIDTKDSQLDSKLFDYFKE KAFPYLSTKHLGVFPDHVIDMFINGYRLSLTN HGPTPVKRGSKDPRGGIFDAVFTRGDQSKLLT NRHDLKNKTLKEISDLIKQELTEGKALGISHT YANVRINHVINLWGADFDAEGNLEAIYVTDSD SNPSIGMKKYFVGVNSSGKVAISAKEIEEDNI GAQVLGLFTLSTGQDIWQNTN (SEQ ID NO: 1112) |
| VRT-91 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDDLLCGAATAGNMLH WWFDQNKEQIENYLKKHPE KQKINFNGEQMFDVKEAID TKDSQLDSKLFEYFLEKAF PYLSTKHLGVFPDHVIDMF INGYRLSLTNHGPTPVKRG SKDPRGGIFDAVFTRGDQS KLLTNRHDLKNKTLKEISD LIKQELTEGKALGISHTYA NVRINHVINLWGADFDAEG NLEAIAVTDSDSNASIGMK KYFVGVNSSGKVAISAKEI EEDNIGAQVLGLFTLSTGQ DIWQNTN (SEQ ID NO: 843) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDDLLC GAATAGNMLHWWFDQNKEQIENYLKKHPEKQK INFNGEQMFDVKEAIDTKDSQLDSKLFEYFLE KAFPYLSTKHLGVFPDHVIDMFINGYRLSLTN HGPTPVKRGSKDPRGGIFDAVFTRGDQSKLLT NRHDLKNKTLKEISDLIKQELTEGKALGISHT YANVRINHVINLWGADFDAEGNLEAIAVTDSD SNASIGMKKYFVGVNSSGKVAISAKEIEEDNI GAQVLGLFTLSTGQDIWQNTN (SEQ ID NO: 1113) |
| VRT-92 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | VTSVWTKGVTPPTDFIYGE DVLHAPYKAGQGWYDITKT FNGKDNLLCGAATAGNMLH WWFDQNKEQIENYLKKHPE KQKIIFNNQELFDLKAAID TKDSQLDSKLFEYFKEKAF PNLSTKHLGVFPDHVIDMF INGYRLSLLNHGPTPVKRG SKDKRGGIFDAVFTRGVQS KLLTNRHDLKNKTLKEISD LIKQELTEGKALGISHTYA IIFNNQELFDLKAAIDTKDSQLDSKLFEYFKE | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDNLLC GAATAGNMLHWWFDQNKEQIENYLKKHPEKQK |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | NVRINHVINLWGADFDAEG NLEAIYVTDSDTNASIGMK KYFVGVNSSGKVAISAKEI NRHDLKNKTLKEISDLIKQELTEGKALGISHT EEDNIGAQVLGLFTLSTGQ DIWNQTN (SEQ ID NO: 844) | KAFPNLSTKHLGVFPDHVIDMFINGYRLSLLN HGPTPVKRGSKDKRGGIFDAVFTRGVQSKLLT NRHDLKNKTLKEISDLIKQELTEGKALGISHT YANVRINHVINLWGADFDAEGNLEAIYVTDSD TNASIGMKKYFVGVNSSGKVAISAKEIEEDNI GAQVLGLFTLSTGQDIWNQTN (SEQ ID NO: 1114) |
| VRT-93 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKT FNGKDNLLCGAATAGNMLH WWFDQNKEQIENYLKKHPE KEYKCKVSNKALKAPIEKTISKAKGQPREPQV KQKIIFNNQELFDLKAAID TKDSQLDSKLFDYFKEKAF PNLSTKHLGVFPDHVIDMF INGYRLSLLNHGPTPVKRG SKDKRGGIFDAVFTRGVQS KLLTNRHDLKNKTLKEISD GAATAGNMLHWWFDQNKEQIENYLKKHPEKQK LIKQELTEGKALGISHTYA NVRINHVINLWGADFDAEG NLEAIYVTDSDTNPSIGMK KYFVGVNSSGKVAISAKEI EEDNIGAQVLGLFTLSTGQ DIWNQTN (SEQ ID NO: 845) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDNLLC GAATAGNMLHWWFDQNKEQIENYLKKHPEKQK LIKQELTEGKALGISHTYA IIFNNQELFDLKAAIDTKDSQLDSKLFDYFKE NVRINHVINLWGADFDAEG KAFPNLSTKHLGVFPDHVIDMFINGYRLSLLN HGPTPVKRGSKDKRGGIFDAVFTRGVQSKLLT NRHDLKNKTLKEISDLIKQELTEGKALGISHT YANVRINHVINLWGADFDAEGNLEAIYVTDSD TNPSIGMKKYFVGVNSSGKVAISAKEIEEDNI GAQVLGLFTLSTGQDIWNQTN (SEQ ID NO: 1115) |
| VRT-94 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL ISRTPEVTCVVVDVSHEDPEVKFNWYVDGVEV FNGKDNLLCGAATAGNMLH HNAKTKPREEQQNSTYRVVSVLTVLHQDWLNG WWFDQNKEQIENYLKKHPE KEYKCKVSNKALKAPIEKTISKAKGQPREPQV KQKIIFNNQELFDLKAAID TKDSQLDSKLFDYFKEKAF WESNGQPENNYKTTPPVLDSDGSFFLYSKLTV PNLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTDF SKDKRGGIFDAVFTRGVQS IYGEDVLHAPYKAGQGWYDITKLFNGKDNLLC KLLTNRHDLKNKTLKEISD GAATAGNMLHWWFDQNKEQIENYLKKHPEKQK LIKQELTEGKALGISHTYA IIFNNQELFDLKAAIDTKDSQLDSKLEDYFKE NGRINHVINLWGADFDAEG KAFPNLSTKHLGVFPDHVIDMFINGYRLSLLN NLEAIYVTDSDINPSIGMK HGPTPVKRGSKDKRGGIFDAVFTRGVQSKLLT KYFVGVNSSGKVAISAKEI NRHDLKNKTLKEISDLIKQELTEGKALGISHT EEDNIGAQVLGLFTLSTGQ YANGRINHVINLWGADFDAEGNLEAIYVTDSD DIWNQTN (SEQ ID NO: 846) | TNPSIGMKKYFVGVNSSGKVAISAKEIEEDNI GAQVLGLFTLSTGQDIWNQTN (SEQ ID NO: 1116) |
| VRT-95 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKT FNGKDNLLCGAATAGNMLH WWFDQNKEQIENYLKKHPE KQKIIFNNQELFDLKAAID TKDSQLDSKLFEYFLEKAF PNLSTKHLGVFPDHVIDMF INGYRLSLLNHGPTPVKRG SKDKRGGIFDAVFTRGVQS KLLTNRHDLKNKTLKEISD LIKQELTEGKALGISHTYA NVRINHVINLWGADFDAEG NLEAIAVTDSDTNASIGMK KYFVGVNSSGKVAISAKEI EEDNIGAQVLGLFTLSTGQ DIWNQTN (SEQ ID NO: 847) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDNLLC GAATAGNMLHWWFDQNKEQIENYLKKHPEKQK LIKQELTEGKALGISHTYA IIFNNQELFDLKAAIDTKDSQLDSKLFEYFLE NVRINHVINLWGADFDAEG KAFPNLSTKHLGVFPDHVIDMFINGYRLSLLN HGPTPVKRGSKDKRGGIFDAVFTRGVQSKLLT NRHDLKNKTLKEISDLIKQELTEGKALGISHT YANVRINHVINLWGADFDAEGNLEAIAVTDSD TNASIGMKKYFVGVNSSGKVAISAKEIEEDNI GAQVLGLFTLSTGQDIWNQTN (SEQ ID NO: 1117) |
| VRT-96 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | VTSVWTKGVTPPTDFIYGE DVLHAPYKAGQGWYDITKL ISRTPEVTCVVVDVSHEDPEVKFNWYVDGVEV FNGKDNLLCGAATAGNMLH HNAKTKPREEQQNSTYRVVSVLTVLHQDWLNG WWFDQNKEQIENYLKKHPE KEYKCKVSNKALKAPIEKTISKAKGQPREPQV KQKIIFNNQELFDLKAAID YTLPPSRDELTKNQVSLTCLVKGFYPSDIAVE TKDSQLDSKLFEYFLEKAF WESNGQPENNYKTTPPVLDSDGSFFLYSKLTV PNLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTDF SKDKRGGIFDAVFTRGVQS IYGEDVLHAPYKAGQGWYDITKLFNGKDNLLC KLLTNRHDLKNKTLKEISD GAATAGNMLHWWFDQNKEQIENYLKKHPEKQK LIKQELTEGKALGISHTYA IIFNNQELFDLKAAIDTKDSQLDSKLFEYFLE NGRINHVINLWGADFDAEG KAFPNLSTKHLGVFPDHVIDMFINGYRLSLLN | |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | NLEAIAVTDSDTNASIGMK KYFVGVNSSGKVAISAKEI EEDNIGAQVLGLFTLSTGQ DIWNQTN (SEQ ID NO: 848) | HGPTPVKRGSKDKRGGIFDAVFTRGVQSKLLT NRHDLKNKTLKEISDLIKQELTEGKALGISHT YANGRINHVINLWGADFDAEGNLEAIAVTDSD TNASIGMKKYFVGVNSSGKVAISAKEIEEDNI GAQVLGLFTLSTGQDIWNQTN (SEQ ID NO: 1118) |
| VRT-97 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDNLLCGAATAGNMLH WWFDQNKEQIENYLKKHPE KQKIIFNNQELFDLKAAID TKDSQLDSKLFDYFKEKAF PYLSTKHLGVFPDHVIDMF INGYRLSLTNHGPTPVKRG SKDKRGGIFDAVFTRGVQS KLLTNRHDLKNKTLKEISD LIKQELTEGKALGISHTYA IIFNNQELFDLKAAIDTKDSQLDSKLFDYFKE NVRINHVINLWGADFDAEG NLEAIYVTDSDINPSIGMK KYFVGVNSSGKVAISAKEI EEDNIGAQVLGLFTLSTGQ DIWNQTN (SEQ ID NO: 849) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDNLLC GAATAGNMLHWWFDQNKEQIENYLKKHPEKQK IIFNNQELFDLKAAIDTKDSQLDSKLFDYFKE KAFPYLSTKHLGVFPDHVIDMFINGYRLSLTN HGPTPVKRGSKDKRGGIFDAVFTRGVQSKLLT NRHDLKNKTLKEISDLIKQELTEGKALGISHT YANVRINHVINLWGADFDAEGNLEAIAVTDSD TNPSIGMKKYFVGVNSSGKVAISAKEIEEDNI GAQVLGLFTLSTGQDIWNQTN (SEQ ID NO: 1119) |
| VRT-98 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDNLLCGAATAGNMLH WWFDQNKEQIENYLKKHPE KQKIIFNNQELFDLKAAID TKDSQLDSKLFEYFLEKAF PYLSTKHLGVFPDHVIDMF INGYRLSLTNHGPTPVKRG SKDKRGGIFDAVFTRGVQS KLLTNRHDLKNKTLKEISD LIKQELTEGKALGISHTYA IIFNNQELFDLKAAIDTKDSQLDSKLFEYFLE NVRINHVINLWGADFDAEG NLEAIAVTDSDTNASIGMK KYFVGVNSSGKVAISAKEI EEDNIGAQVLGLFTLSTGQ DIWNQTN (SEQ ID NO: 850) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDNLLC GAATAGNMLHWWFDQNKEQIENYLKKHPEKQK IIFNNQELFDLKAAIDTKDSQLDSKLFEYFLE KAFPYLSTKHLGVFPDHVIDMFINGYRLSLIN HGPTPVKRGSKDKRGGIFDAVFTRGVQSKLLT NRHDLKNKTLKEISDLIKQELTEGKALGISHT YANVRINHVINLWGADFDAEGNLEAIAVTDSD TNASIGMKKYFVGVNSSGKVAISAKEIEEDNI GAQVLGLFTLSTGQDIWNQTN (SEQ ID NO: 1120) |
| VRT-99 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYVANQGWYDITKT FNGKDDLLCGAATAGNMLH WWFDQNKEKIEAYLKKHPD KQKIMFGDQELLDVRKVIN TKGDQTNSELFNYFRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT YANVGINHVINLWGADFDS NGNLKAIYVTDSDSNASIG MKKYFVGVNSSGKVAISAK EIKEDNIGAQVLGLFTLST GQDSWNQTN (SEQ ID NO: 851) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYVANQGWYDITKTFNGKDDLLC GAATAGNMLHWWFDQNKEKIEAYLKKHPDKQK IMFGDQELLDVRKVINTKGDQTNSELFNYFRD KAFPNLSARRIGVMPDLVLDMFINGYYLNVYK TQTTDVNRTYQEKDRRGGIFDAVFTRGDQSKL LTSRHDFKEKNLKEISDLIKKELTEGKALGLS HTYANVGINHVINLWGADFDSNGNLKAIYVTD SDSNASIGMKKYFVGVNSSGKVAISAKEIKED NIGAQVLGLFTLSTGQDSWNQTN (SEQ ID NO: 1121) |
| VRT-100 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | VTSVWTKGVTPPAKFTQGE DVFHAPYVANQGWYDITKT FNGKDDLLCGAATAGNMLH WWFDQNKEKIEAYLKKHPD KQKIMFGDQELLDVRKVIN TKGDQTNSELFNYFRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT YANVRIGHVINLWGADFDS NGNLKAIYVTDSDSNASIG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYVANQGWYDITKTENGKDDLLC GAATAGNMLHWWFDQNKEKIEAYLKKHPDKQK IMFGDQELLDVRKVINTKGDQTNSELFNYFRD KAFPNLSARRIGVMPDLVLDMFINGYYLNVYK TQTTDVNRTYQEKDRRGGIFDAVFTRGDQSKL |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | MKKYFVGVNSSGKVAISAK EIKEDNIGAQVLGLFTLST GQDSWNQTN (SEQ ID NO: 852) | LTSRHDFKEKNLKEISDLIKKELTEGKALGLS HTYANVRIGHVINLWGADFDSNGNLKAIYVTD SDSNASIGMKKYFVGVNSSGKVAISAKEIKED NIGAQVLGLFTLSTGQDSWNQTN (SEQ ID NO: 1122) |
| VRT-101 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYVANQGWYDITKT FNGKDDLLCGAATAGNMLH WWFDQNKEKIEAYLKKHPD KQKIMFGDQELLDVRKVIN TKGDQTNSELFNYFRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT IMFGDQELLDVRKVINTKGDQTNSELFNYRD YANVRLNHVINLWGADFDS KAFPNLSARRIGVMPDLVLDMFINGYYLNVYK NGNLKAIYVTDSDSNASIG TQTTDVNRTYQEKDRRGGIFDAVFTRGDQSKL MKKYFVGVNSSGKVAISAK LTSRHDFKEKNLKEISDLIKKELTEGKALGLS EIKEDNIGAQVLGLFTLST HTYANVRLNHVINLWGADFDSNGNLKAIYVTD GQDSWNQTN (SEQ ID NO: 853) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYVANQGWYDITKTFNGKDDLLC GAATAGNMLHWWFDQNKEKIEAYLKKHPDKQK SDSNASIGMKKYFVGVNSSGKVAISAKEIKED NIGAQVLGLFTLSTGQDSWNQTN (SEQ ID NO: 1123) |
| VRT-102 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYDANQGWYDITKT FNGKDDLLCGAATAGNMLH WWFDQNKEKIEAYLKKHPD KQKIMFGDQELLDVRKVIN TKGDQTNSELFNYFRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT IMFGDQELLDVRKVINTKGDQTNSELFNYRD YANVRISHVINLWGADFDS KAFPNLSARRIGVMPDLVLDMFINGYYLNVYK NGNLKAIYVTDSDSNASIG TQTTDVNRTYQEKDRRGGIFDAVFTRGDQSKL MKKYFVGVNSAGKVAISAK LTSRHDFKEKNLKEISDLIKKELTEGKALGLS EIKEDNIGAQVLGLFTLST HTYANVRISHVINLWGADFDSNGNLKAIYVTD GQDSWNQTN (SEQ ID NO: 854) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYDANQGWYDITKTFNGKDDLLC GAATAGNMLHWWFDQNKEKIEAYLKKHPDKQK SDSNASIGMKKYFVGVNSAGKVAISAKEIKED NIGAQVLGLFTLSTGQDSWNQTN (SEQ ID NO: 1124) |
| VRT-103 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYVANQGWYDITKT FNGKDDLLCGAATAGNMLH WWFDQNKEKIEAYLKKHPD KQKIMFGDQELLDVRKVIN TKGDQTNSELFNYFRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT IMFGDQELLDVRKVINTKGDQTNSELFNYRD YANVRLNHVINLWGADFDS KAFPNLSARRIGVMPDLVLDMFINGYYLNVYK NGNLKAIYVTDSDSNASIG TQTTDVNRTYQEKDRRGGIFDAVFTRGDQSKL MKKYGVGVNSAGKVAISAK LTSRHDFKEKNLKEISDLIKKELTEGKALGLS EIKEDNIGAQVLGLFTLST HTYANVRLNHVINLWGADFDSNGNLKAIYVTD GQDSWNQTN (SEQ ID NO: 855) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYVANQGWYDITKTFNGKDDLLC GAATAGNMLHWWFDQNKEKIEAYLKKHPDKQK SDSNASIGMKKYGVGVNSAGKVAISAKEIKED NIGAQVLGLFTLSTGQDSWNQTN (SEQ ID NO: 1125) |
| VRT-104 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGGSGG GGSGGGG SG (SEQ ID NO: 1020) | VTSVWTKGVTPPAKFTQGE DVFHAPYDANQGWYDITKT FNGKDDLLCGAATAGNMLH WWFDQNKEKIEAYLKKHPD KQKIMFGDQELLDVRKVIN TKGDQTNSELFNYFRDKAF PGLSARRIGVMPDLVLDMF INGYYLNVYKTQTTDVNRT YQEKDRRGGIFDAVFTRGD QSKLLTSRHDFKEKNLKEI SDLIKKELTEGKALGLSHT IMFGDQELLDVRKVINTKGDQTNSELFNYRD YANVRISHVINLWGADFDS KAFPGLSARRIGVMPDLVLDMFINGYYLNVYK NGNLKAIYVTDSDSNASIG TQTTDVNRTYQEKDRRGGIFDAVFTRGDQSKL MKKYGVGVNSAGKVAISAK LTSRHDFKEKNLKEISDLIKKELTEGKALGLS | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | EIKEDNIGAQVLGLFTLST GQDSWNQTN (SEQ ID NO: 856) | HTYANVRISHVINLWGADFDSNGNLKAIYVTD SDSNASIGMKKYGVGVNSAGKVAISAKEIKED NIGAQVLGLFTLSTGQDSWNQTN (SEQ ID NO: 1126) |
| VRT-105 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYDANQGWYDITKT FNGKDDLLCGAATAGNMLH WWFDQNKEKIEAYLKKHPD KQKIMFGDQELLDVRKVIN TKGDQTNSELFNYRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT YANVRISHVINLWGADFDS NGNLKAIYVTDSDSNASIG MKKYFVGVNSSGKVAISAK EIKEDNIGAQVLGLFTLST GQDSWNQTN (SEQ ID NO: 857) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYDANQGWYDITKTFNGKDDLLC GAATAGNMLHWWFDQNKEKIEAYLKKHPDKQK IMFGDQELLDVRKVINTKGDQTNSELFNYRD KAFPNLSARRIGVMPDLVLDMFINGYYLNVYK TQTTDVNRTYQEKDRRGGIFDAVFTRGDQSKL LTSRHDFKEKNLKEISDLIKKELTEGKALGLS HTYANVRISHVINLWGADFDSNGNLKAIYVTD SDSNASIGMKKYFVGVNSSGKVAISAKEIKED NIGAQVLGLFTLSTGQDSWNQTN (SEQ ID NO: 1127) |
| VRT-106 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYVANQGWYDITKE FNGKDDLLCGAATAGNMLH WWFDQNKEKIEAYLKKHPD KQKIMFGDQELLDVRKVIN TKGDQTNSELFNYRDKAF PNLSARRIGVMPDLVLDMF DKSRWQQGNVFSCSVMHEALHNHYTQKSLSLS INGYYLNVYKTQTTDVNRT YQEKDRRGGIFDAVFTRGD TQGEDVFHAPYVANQGWYDITKEFNGKDDLLC QSKLLTSRHDFKEKNLKEI GAATAGNMLHWWFDQNKEKIEAYLKKHPDKQK SDLIKKELTEGKALGLSHT IMFGDQELLDVRKVINTKGDQTNSELFNYRD YANVRIGHVINLWGADFDS KAFPNLSARRIGVMPDLVLDMFINGYYLNVYK NGNLKAIYVTDSDSNASIG TQTTDVNRTYQEKDRRGGIFDAVFTRGDQSKL MKKYGVGVNSAGKVAISAK LTSRHDFKEKNLKEISDLIKKELTEGKALGLS EIKEDNIGAQVLGLFTLST HTYANVRIGHVINLWGADFDSNGNLKAIYVTD GQDSWNQTN (SEQ ID NO: 858) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV PNLSARRIGVMPDLVLDMFINGYYLNVYK SDSNASIGMKKYGVGVNSAGKVAISAKEIKED NIGAQVLGLFTLSTGQDSWNQTN (SEQ ID NO: 1128) |
| VRT-107 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYDANQGWYDITKE FNGKDDLLCGAATAGNMLH WWFDQNKEKIEAYLKKHPD KQKIMFGDQELLDVRKVIN TKGDQTNSELFNYRDKAF PNLSARRIGVMPDLVLDMF INGYYLNVYKTQTTDVNRT YQEKDRRGGIFDAVFTRGD QSKLLTSRHDFKEKNLKEI SDLIKKELTEGKALGLSHT YANVRIGHVINLWGADFDS NGNLKAIYVTDSDSNASIG MKKYGVGVNSAGKVAISAK EIKEDNIGAQVLGLFTLST GQDSWNQTN (SEQ ID NO: 859) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYDANQGWYDITKEFNGKDDLLC GAATAGNMLHWWFDQNKEKIEAYLKKHPDKQK IMFGDQELLDVRKVINTKGDQTNSELFNYRD KAFPNLSARRIGVMPDLVLDMFINGYYLNVYK TQTTDVNRTYQEKDRRGGIFDAVFTRGDQSKL LTSRHDFKEKNLKEISDLIKKELTEGKALGLS HTYANVRIGHVINLWGADFDSNGNLKAIYVTD SDSNASIGMKKYGVGVNSAGKVAISAKEIKED NIGAQVLGLFTLSTGQDSWNQTN (SEQ ID NO: 1129) |
| VRT-108 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGGSGG GGSGGGG SG (SEQ ID NO: 1020) | VTSVWTKGVTPPADFTQGE DVFHAPYVANQGWYDITKT FNGKDDLLCGAATAGNMLH WWFDQNKEYIEAYLKKHPE KQKIMFGDQELLDVRKAIN TKGSQKNSELFNYRDKAF PNLSARRLGVMPDLVLDMF INGYYLNVYKTQTTDVNRT YQEKDRGGIFDAVFTRGD QSKLLTSRHDFKEKGLKEI GAATAGNMLHWWFDQNKEYIEAYLKKHPDKQK SDLIKQELTEGKALGLSHT IMFGDQELLDVRKAINTKGSQKNSELFNYRD YANVGINHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYFVGVNSSGKVAISAK LTSRHDFKEKGLKEISDLIKQELTEGKALGLS EIKEDNIGAQVLGLFTLST HTYANVGINHVINLWGADFDSDGNLKAIYVTD | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYVANQGWYDITKTFNGKDDLLC |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | GQDIWNQTN (SEQ ID NO: 860) | SDSNASIGMKKYFVGVNSSGKVAISAKEIKED NIGAQVLGLFTLSTGQDIWNQTN (SEQ ID NO: 1130) |
| VRT-109 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPADFTQGE DVFHAPYVANQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT IMFGDQELLDVRKAINTKGSQKNSELFNYFRD YANVRIGHVINLWGADFDS DGNLKAIYVTDSDSNASIG MKKYFVGVNSSGKVAISAK EIKEDNIGAQVLGLFTLST GQDIWNQTN (SEQ ID NO: 861) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYVANQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRIGHVINLWGADFDSDGNLKAIYVTD SDSNASIGMKKYFVGVNSSGKVAISAKEIKED NIGAQVLGLFTLSTGQDIWNQTN (SEQ ID NO: 1131) |
| VRT-110 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPADFTQGE DVFHAPYVANQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRLNHVINLWGADFDS DGNLKAIYVTDSDSNASIG MKKYFVGVNSSGKVAISAK EIKEDNIGAQVLGLFTLST GQDIWNQTN (SEQ ID NO: 862) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYVANQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRLNHVINLWGADFDSDGNLKAIYVTD SDSNASIGMKKYFVGVNSSGKVAISAKEIKED NIGAQVLGLFTLSTGQDIWNQTN (SEQ ID NO: 1132) |
| VRT-111 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GSGGGGG SG (SEQ ID NO: 1020) | VTSVWTKGVTPPADFTQGE DVFHAPYDANQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRISHVINLWGADFDS DGNLKAIYVTDSDSNASIG MKKYFVGVNSAGKVAISAK EIKEDNIGAQVLGLFTLST GQDIWNQTN (SEQ ID NO: 863) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYDANQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRISHVINLWGADFDSDGNLKAIYVTD SDSNASIGMKKYFVGVNSAGKVAISAKEIKED NIGAQVLGLFTLSTGQDIWNQTN (SEQ ID NO: 1133) |
| VRT-112 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE | GGGGSGG GSGGGGG SG (SEQ ID NO: 1020) | VTSVWTKGVTPPADFTQGE DVFHAPYVANQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS |

TABLE 8-continued

| ID | N-terminus Fc Moiety | Linker | C-terminus Protease Moiety | Full length Sequence |
|---|---|---|---|---|
| | YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | INGYYLNVTKTQTTDVNRT YQEKDKRGGIFDAVFTRGD QSKLLTSRHDFKEKGLKEI GAATAGNMLHWWFDQNKEYIEAYLKKHPEKQK SDLIKQELTEGKALGLSHT IMFGDQELLDVRKAINTKGSQKNSELFNYFRD YANVRLNHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYGVGVNSAGKVAISAK LTSRHDFKEKGLKEISDLIKQELTEGKALGLS EIKEDNIGAQVLGLFTLST HTYANVRLNHVINLWGADFDSDGNLKAIYVTD GQDIWNQTN (SEQ ID SDSNASIGMKKYGVGVNSAGKVAISAKEIKED NO: 864) NIGAQVLGLFTLSTGQDIWNQTN (SEQ ID NO: 1134) |
| VRT-113 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DKTHTCPPCPAPEAAGAPSVFLFPPKPKDTLM DVFHAPYDANQGWYDITKT ISRTPEVTCVVVDVSHEDPEVKFNWYVDGVEV FNGKDDLLCGAATAGNMLH HNAKTKPREEQQNSTYRVVSVLTVLHQDWLNG WWFDQNKEYIEAYLKKHPE KEYKCKVSNKALKAPIEKTISKAKGQPREPQV KQKIMFGDQELLDVRKAIN YTLPPSRDELTKNQVSLTCLVKGFYPSDIAVE TKGSQKNSELFNYFRDKAF WESNGQPENNYKTTPPVLDSDGSFFLYSKLTV PNLSARRLGVMPDLVLDMF DKSRWQQGNVFSCSVMHEALHNHYTQKSLSLS INGYYLNVTKTQTTDVNRT PGGGGSGGGGSGGGGSGVTSVWTKGVTPPADF YQEKDKRGGIFDAVFTRGD TQGEDVFHAPYDANQGWYDITKTFNGKDDLLC QSKLLTSRHDFKEKGLKEI GAATAGNMLHWWFDQNKEYIEAYLKKHPEKQK SDLIKQELTEGKALGLSHT IMFGDQELLDVRKAINTKGSQKNSELFNYFRD YANVRISHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYGVGVNSAGKVAISAK LTSRHDFKEKGLKEISDLIKQELTEGKALGLS EIKEDNIGAQVLGLFTLST HTYANVRISHVINLWGADFDSDGNLKAIYVTD GQDIWNQTN (SEQ ID SDSNASIGMKKYGVGVNSAGKVAISAKEIKED NO: 865) NIGAQVLGLFTLSTGQDIWNQTN (SEQ ID NO: 1135) |
| VRT-114 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DKTHTCPPCPAPEAAGAPSVFLFPPKPKDTLM DVFHAPYDANQGWYDITKT ISRTPEVTCVVVDVSHEDPEVKFNWYVDGVEV FNGKDDLLCGAATAGNMLH HNAKTKPREEQQNSTYRVVSVLTVLHQDWLNG WWFDQNKEYIEAYLKKHPE KEYKCKVSNKALKAPIEKTISKAKGQPREPQV KQKIMFGDQELLDVRKAIN YTLPPSRDELTKNQVSLTCLVKGFYPSDIAVE TKGSQKNSELFNYFRDKAF WESNGQPENNYKTTPPVLDSDGSFFLYSKLTV PNLSARRLGVMPDLVLDMF DKSRWQQGNVFSCSVMHEALHNHYTQKSLSLS INGYYLNVTKTQTTDVNRT PGGGGSGGGGSGGGGSGVTSVWTKGVTPPADF YQEKDKRGGIFDAVFTRGD TQGEDVFHAPYDANQGWYDITKTFNGKDDLLC QSKLLTSRHDFKEKGLKEI GAATAGNMLHWWFDQNKEYIEAYLKKHPEKQK SDLIKQELTEGKALGLSHT IMFGDQELLDVRKAINTKGSQKNSELFNYFRD YANVRISHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYFVGVNSSGKVAISAK LTSRHDFKEKGLKEISDLIKQELTEGKALGLS EIKEDNIGAQVLGLFTLST HTYANVRISHVINLWGADFDSDGNLKAIYVTD GQDIWNQTN (SEQ ID SDSNASIGMKKYFVGVNSSGKVAISAKEIKED NO: 866) NIGAQVLGLFTLSTGQDIWNQTN (SEQ ID NO: 1136) |
| VRT-115 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DKTHTCPPCPAPEAAGAPSVFLFPPKPKDTLM DVFHAPYVANQGWYDITKE ISRTPEVTCVVVDVSHEDPEVKFNWYVDGVEV FNGKDDLLCGAATAGNMLH HNAKTKPREEQQNSTYRVVSVLTVLHQDWLNG WWFDQNKEYIEAYLKKHPE KEYKCKVSNKALKAPIEKTISKAKGQPREPQV KQKIMFGDQELLDVRKAIN YTLPPSRDELTKNQVSLTCLVKGFYPSDIAVE TKGSQKNSELFNYFRDKAF WESNGQPENNYKTTPPVLDSDGSFFLYSKLTV PNLSARRLGVMPDLVLDMF DKSRWQQGNVFSCSVMHEALHNHYTQKSLSLS INGYYLNVTKTQTTDVNRT PGGGGSGGGGSGGGGSGVTSVWTKGVTPPADF YQEKDKRGGIFDAVFTRGD TQGEDVFHAPYVANQGWYDITKEFNGKDDLLC QSKLLTSRHDFKEKGLKEI GAATAGNMLHWWFDQNKEYIEAYLKKHPEKQK SDLIKQELTEGKALGLSHT IMFGDQELLDVRKAINTKGSQKNSELFNYFRD YANVRIGHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYGVGVNSAGKVAISAK LTSRHDFKEKGLKEISDLIKQELTEGKALGLS EIKEDNIGAQVLGLFTLST HTYANVRIGHVINLWGADFDSDGNLKAIYVTD GQDIWNQTN (SEQ ID SDSNASIGMKKYGVGVNSAGKVAISAKEIKED NO: 867) NIGAQVLGLFTLSTGQDIWNQTN (SEQ ID NO: 1137) |
| VRT-116 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI | GGGGSGG GGSGGGG SG (SEQ ID NO: 1020) | VTSVWTKGVTPPADFTQGE DKTHTCPPCPAPEAAGAPSVFLFPPKPKDTLM DVFHAPYDANQGWYDITKE ISRTPEVTCVVVDVSHEDPEVKFNWYVDGVEV FNGKDDLLCGAATAGNMLH HNAKTKPREEQQNSTYRVVSVLTVLHQDWLNG WWFDQNKEYIEAYLKKHPE KEYKCKVSNKALKAPIEKTISKAKGQPREPQV KQKIMFGDQELLDVRKAIN YTLPPSRDELTKNQVSLTCLVKGFYPSDIAVE TKGSQKNSELFNYFRDKAF WESNGQPENNYKTTPPVLDSDGSFFLYSKLTV PNLSARRLGVMPDLVLDMF DKSRWQQGNVFSCSVMHEALHNHYTQKSLSLS INGYYLNVTKTQTTDVNRT PGGGGSGGGGSGGGGSGVTSVWTKGVTPPADF |

TABLE 8-continued

| ID | N-terminus Fc Moiety | Linker | C-terminus Protease Moiety | Full length Sequence |
|---|---|---|---|---|
| | EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | YQEKDKRGGIFDAVFTRGD QSKLLTSRHDFKEKGLKEI SDLIKQELTEGKALGLSHT IMFGDQELLDVRKAINTKGSQKNSELFNYFRD YANVRIGHVINLWGADFDS DGNLKAIYVTDSDSNASIG MKKYGVGVNSAGKVAISAK EIKEDNIGAQVLGLFTLST GQDIWNQTN (SEQ ID NO: 868) | TQGEDVFHAPYDANQGWYDITKEFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRIGHVINLWGADFDSDGNLKAIYVTD SDSNASIGMKKYGVGVNSAGKVAISAKEIKED NIGAQVLGLFTLSTGQDIWNQTN (SEQ ID NO: 1138) |
| VRT-117 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYKAGQGWYDITKT FNGKDDLLCGAATAGNMLH WWFDQNKEYIEAYLKKHPE KQKIMFGDQELLDVRKAIN TKGSQKNSELFNYFRDKAF WESNGQPENNYKTTPPVLDSDGSFFLYSKLTV PNLSARRLGVMPDLVLDMF DKSRWQQGNVFSCSVMHEALHNHYTQKSLSLS INGYYLNVTKTQTTDVNRT PGGGGSGGGGSGGGGSGVTSVWTKGVTPPTDF YQEKDKRGGIFDAVFTRGD IKGEDVFHAPYKAGQGWYDITKTFNGKDDLLC QSKLLTSRHDFKEKGLKEI GAATAGNMLHWWFDQNKEYIEAYLKKHPEKQK SDLIKQELTEGKALGLSHT IMFGDQELLDVRKAINTKGSQKNSELFNYFRD YANVGINHVINLWGADFDS KAFPNLSARRLGVMPDLVLDMFINGYYLNVTK DGNLKAIYVTDSDSNASIG TQTTDVNRTYQEKDKRGGIFDAVFTRGDQSKL MKKYFVGVNSSGKVAISAK LTSRHDFKEKGLKEISDLIKQELTEGKALGLS EIKEDNIGAQVLGLFTLST HTYANVGINHVINLWGADFDSDGNLKAIYVTD GQDIWNQTN (SEQ ID NO: 869) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYKAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVGINHVINLWGADFDSDGNLKAIYVTD SDSNASIGMKKYFVGVNSSGKVAISAKEIKED NIGAQVLGLFTLSTGQDIWNQTN (SEQ ID NO: 1139) |
| VRT-118 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYKAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRIGHVINLWGADFDS DGNLKAIYVTDSDSNASIG MKKYFVGVNSSGKVAISAK EIKEDNIGAQVLGLFTLST GQDIWNQTN (SEQ ID NO: 870) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYKAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRIGHVINLWGADFDSDGNLKAIYVTD SDSNASIGMKKYFVGVNSSGKVAISAKEIKED NIGAQVLGLFTLSTGQDIWNQTN (SEQ ID NO: 1140) |
| VRT-119 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYKAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRLNHVINLWGADFDS DGNLKAIYVTDSDSNASIG MKKYFVGVNSSGKVAISAK EIKEDNIGAQVLGLFTLST GQDIWNQTN (SEQ ID NO: 871) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYKAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRLNHVINLWGADFDSDGNLKAIYVTD SDSNASIGMKKYFVGVNSSGKVAISAKEIKED NIGAQVLGLFTLSTGQDIWNQTN (SEQ ID NO: 1141) |
| VRT-120 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP | GGGGSGG GGSGGGG SG (SEQ ID NO: 1020) | VTSVWTKGVTPPTDFIKGE DVFHAPYDAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYDAGQGWYDITKTFNGKDDLLC |

TABLE 8-continued

| ID | N-terminus Fc Moiety | Linker | C-terminus Protease Moiety | Full length Sequence |
|---|---|---|---|---|
| | QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | QSKLLTSRHDFKEKGLKEI SDLIKQELTEGKALGLSHT YANVRISHVINLWGADFDS DGNLKAIYVTDSDSNASIG MKKYFVGVNSAGKVAISAK EIKEDNIGAQVLGLFTLST GQDIWNQTN (SEQ ID NO: 872) | GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRISHVINLWGADFDSDGNLKAIYVTD SDSNASIGMKKYFVGVNSAGKVAISAKEIKED NIGAQVLGLFTLSTGQDIWNQTN (SEQ ID NO: 1142) |
| VRT-121 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYKAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRLNHVINLWGADFDS DGNLKAIYVTDSDSNASIG MKKYGVGVNSAGKVAISAK EIKEDNIGAQVLGLFTLST GQDIWNQTN (SEQ ID NO: 873) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYKAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRLNHVINLWGADFDSDGNLKAIYVTD SDSNASIGMKKYGVGVNSAGKVAISAKEIKED NIGAQVLGLFTLSTGQDIWNQTN (SEQ ID NO: 1143) |
| VRT-122 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYDAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRISHVINLWGADFDS DGNLKAIYVTDSDSNASIG MKKYGVGVNSAGKVAISAK EIKEDNIGAQVLGLFTLST GQDIWNQTN (SEQ ID NO: 874) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYDAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRISHVINLWGADFDSDGNLKAIYVTD SDSNASIGMKKYGVGVNSAGKVAISAKEIKED NIGAQVLGLFTLSTGQDIWNQTN (SEQ ID NO: 1144) |
| VRT-123 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYDAGQGWYDITKT FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI SDLIKQELTEGKALGLSHT YANVRISHVINLWGADFDS DGNLKAIYVTDSDSNASIG MKKYFVGVNSSGKVAISAK EIKEDNIGAQVLGLFTLST GQDIWNQTN (SEQ ID NO: 875) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYDAGQGWYDITKTFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRISHVINLWGADFDSDGNLKAIYVTD SDSNASIGMKKYFVGVNSSGKVAISAKEIKED NIGAQVLGLFTLSTGQDIWNQTN (SEQ ID NO: 1145) |
| VRT-124 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK | GGGGSGG GGSGGGG SG (SEQ ID NO: 1020) | VTSVWTKGVTPPTDFIKGE DVFHAPYKAGQGWYDITKE FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKTQTTDVNRT YQEKDKRGGIFDAVFTRGD QSKLLTSRHDFKEKGLKEI | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYKAGQGWYDITKEFNGKDDLLC GAATAGNMLHWWFDQNKEYIEAYLKKHPEKQK |

TABLE 8-continued

| ID | N-terminus Fc Moiety | Linker | C-terminus Protease Moiety | Full length Sequence |
|---|---|---|---|---|
| | NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | SDLIKQELTEGKALGLSHT YANVRIGHVINLWGADFDS DGNLKAIYVTDSDSNASIG MKKYGVGVNSAGKVAISAK EIKEDNIGAQVLGLFTLST GQDIWNQTN (SEQ ID NO: 876) | IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRIGHVINLWGADFDSDGNLKAIYVTD SDSNASIGMKKYGVGVNSAGKVAISAKEIKED NIGAQVLGLFTLSTGQDIWNQTN (SEQ ID NO: 1146) |
| VRT-125 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIKGE DVFHAPYDAGQGWYDITKE FNGKDDLLCGAATAGNMLH WWFDQNKEYIEAYLKKHPE KQKIMFGDQELLDVRKAIN TKGSQKNSELFNYFRDKAF PNLSARRLGVMPDLVLDMF INGYYLNVTKQTTDVNRT YQEKDKRGGIFDAVFTRGD QSKLLTSRHDFKEKGLKEI SDLIKQELTEGKALGLSHT YANVRIGHVINLWGADFDS DGNLKAIYVTDSDSNASIG MKKYGVGVNSAGKVAISAK EIKEDNIGAQVLGLFTLST GQDIWNQTN (SEQ ID NO: 877) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IKGEDVFHAPYDAGQGWYDITKEFNGKDDLLC GAATAGNMLHWWFDQNKEYIEAYLKKHPEKQK IMFGDQELLDVRKAINTKGSQKNSELFNYFRD KAFPNLSARRLGVMPDLVLDMFINGYYLNVTK TQTTDVNRTYQEKDKRGGIFDAVFTRGDQSKL LTSRHDFKEKGLKEISDLIKQELTEGKALGLS HTYANVRIGHVINLWGADFDSDGNLKAIYVTD SDSNASIGMKKYGVGVNSAGKVAISAKEIKED NIGAQVLGLFTLSTGQDIWNQTN (SEQ ID NO: 1147) |
| VRT-126 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR KNNEDVIHAPYLAHQGWYD ITKAFDGKDNLLCGAATAG NMLHWWFDQNKTEIEAYLS KHPEKQKIIFNNQELFDLK AAIDTKDSQTNSQLFNYFR DKAFPNLSARQLGVMPDLV LDMFINGYYLNVGKTQSTD VNRPYQDKDKRGGIFDAVF TRGDQTTLLTARHDLKNKG NLLCGAATAGNMLHWWFDQNKTEIEAYLSKHP LNDISTIIKQELTEGRALA EKQKIIFNNQELFDLKAAIDTKDSQTNSQLFN LSHTYANVSISHVINLWGA YFRDKAFPNLSARQLGVMPDLVLDMFINGYYL DFNAEGNLEAIYVTDSDAN NVGKTQSTDVNRPYQDKDKRGGIFDAVFTRGD ASIGMKKYFVGRNAHGHVA ISAKKIEGENIGAQVLGLF LALSHTYANVSISHVINLWGADFNAEGNLEAI TLSSGKDIWQKLS (SEQ ID NO: 878) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRKNNEDVIHAPYLAHQGWYDITKAFDGKD NLLCGAATAGNMLHWWFDQNKTEIEAYLSKHP EKQKIIFNNQELFDLKAAIDTKDSQTNSQLFN YFRDKAFPNLSARQLGVMPDLVLDMFINGYYL NVGKTQSTDVNRPYQDKDKRGGIFDAVFTRGD QTTLLTARHDLKNKGLNDISTIIKQELTEGRA LALSHTYANVSISHVINLWGADFNAEGNLEAI YVTDSDANASIGMKKYFVGRNAHGHVAISAKK IEGENIGAQVLGLFTLSSGKDIWQKLS (SEQ ID NO: 1148) |
| VRT-127 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFNNQELFDLK AAIDTKDSQTNSQLFNYFR DKAFPNLSARQLGVMPDLV LDMFINGYYLNVGKTQSTD VNRPYQDKDKRGGIFDAVF TRGDQTTLLTARHDLKNKG LNDISTIIKQELTEGRALA LSHTYANVSISHVINLWGA YFRDKAFPNLSARQLGVMPDLVLDMFINGYYL DFDAEGNLEAIYVTDSDAN NVGKTQSTDVNRPYQDKDKRGGIFDAVFTRGD ASIGMKKYFVGRNAHGHVA ISAKKIEGENIGAQVLGLF LALSHTYANVSISHVINLWGADFDAEGNLEAI TLSLGKDIWQKLS (SEQ ID NO: 879) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFNNQELFDLKAAIDTKDSQTNSQLFN YFRDKAFPNLSARQLGVMPDLVLDMFINGYYL NVGKTQSTDVNRPYQDKDKRGGIFDAVFTRGD QTTLLTARHDLKNKGLNDISTIIKQELTEGRA LALSHTYANVSISHVINLWGADFDAEGNLEAI YVTDSDANASIGMKKYFVGRNAHGHVAISAKK IEGENIGAQVLGLFTLSLGKDIWQKLS (SEQ ID NO: 1149) |
| VRT-128 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFDYFR DKAFPNLSARQLGVMPDLV LDMFINGYYLNVGKTQSTD VNRPYQDKDKRGGIFDAVF TRGDQTTLLTARHDLKNKG LNDISTIIKQELTEGRALA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFD |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | LSHTYANVSISHVINLWGA DFDAEGNLEAIYVTDSDAN ASIGMKKYFVGRNAHGHVA ISAKKIEGENIGAQVLGLF TLSSGKDQWQKLS (SEQ ID NO: 880) | YFRDKAFPNLSARQLGVMPDLVLDMFINGYYL NVGKTQSTDVNRPYQDKDKRGGIFDAVFTRGD QTTLLTARHDLKNKGLNDISTIIKQELTEGRA LALSHTYANVSISHVINLWGADFDAEGNLEAI YVTDSDANASIGMKKYFVGRNAHGHVAISAKK IEGENIGAQVLGLFTLSSGKDQWQKLS (SEQ ID NO: 1150) |
| VRT-129 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFNNQELFDLK AAIDTKDSQTNSQLFDYFR DKAFPNLSARQLGVMPDLV LDMFINGYYLNVPKTQSTD VNRPYQDKDKRGGIFDAVF TRGDQTTLLTARHDLKNKG LNDISTIIKQELTEGRALA LSHTYANVSISHVINLWGA DFDAEGNLEAIYVTDSDAN ASIGMKKYFVGRNAHGHVA ISAKKIEGENIGAQVLGLF TLSSGKDQWQKLS (SEQ ID NO: 881) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFNNQELFDLKAAIDTKDSQTNSQLFD YFRDKAFPNLSARQLGVMPDLVLDMFINGYYL NVPKTQSTDVNRPYQDKDKRGGIFDAVFTRGD QTTLLTARHDLKNKGLNDISTIIKQELTEGRA LALSHTYANVSISHVINLWGADFDAEGNLEAI YVTDSDANASIGMKKYFVGRNAHGHVAISAKK IEGENIGAQVLGLFTLSSGKDQWQKLS (SEQ ID NO: 1151) |
| VRT-130 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFNNQEWFDLK AAIDTKDSQTNSQLFNYFR DKAFPNLSARQLGVMPDLV LDMFINGYYLNVPKTQSTD VNRPYQDKDKRGGIFDAVF TRGDQTTLLTARHDLKNKG LNDISTIIKQELTEGRALA LSHTYANVSISHVINLWGA DFNAEGNLEAIYVTDSDAN ASIGMKKYAVGINAHGHVA ISAKKIEGENIGAQVLGLF TLSSGKDIWQKLS (SEQ ID NO: 882) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFNNQEWFDLKAAIDTKDSQTNSQLFN YFRDKAFPNLSARQLGVMPDLVLDMFINGYYL NVPKTQSTDVNRPYQDKDKRGGIFDAVFTRGD QTTLLTARHDLKNKGLNDISTIIKQELTEGRA LALSHTYANVSISHVINLWGADFNAEGNLEAI YVTDSDANASIGMKKYAVGINAHGHVAISAKK IEGENIGAQVLGLFTLSSGKDIWQKLS (SEQ ID NO: 1152) |
| VRT-131 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFR DKAFPNLSARQLGVMPDLV LDMFINGYYLNVGKTQSTD VNRPYQDKDKRGGIFDAVF TRGDQTTLLTARHDLKNKG LNDISTIIKQELTEGRALA LSHTYANVSISHVINLWGA DFNAEGNLEAIYVTDSDAN PSIGMKKYFVGRNAHGHVA ISAKKIEGENIGAQVLGLF TLSSGKDIWQKLS (SEQ ID NO: 883) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN YFRDKAFPNLSARQLGVMPDLVLDMFINGYYL NVGKTQSTDVNRPYQDKDKRGGIFDAVFTRGD QTTLLTARHDLKNKGLNDISTIIKQELTEGRA LALSHTYANVSISHVINLWGADFNAEGNLEAI YVTDSDANPSIGMKKYFVGRNAHGHVAISAKK IEGENIGAQVLGLFTLSSGKDIWQKLS (SEQ ID NO: 1153) |
| VRT-132 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFDYFR DKAFPNLSARQLGVMPDLV LDMFINGYYLNVGKTQSTD VNRPYQDKDKRGGIFDAVF TRGDQTTLLTARHDLKNKG LNDISTIIKQELTEGRALA LSHTYANVSISHVINLWGA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFD YFRDKAFPNLSARQLGVMPDLVLDMFINGYYL |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | DFNAEGELEAIYVTDSDAN PSIGMKKYFVGRNAHGVA ISAKKIEGENIGAQVLGLF TLSSGKDIWQKLS (SEQ ID NO: 884) | NVGKTQSTDVNRPYQDKDKRGGIFDAVFTRGD QTTLLTARHDLKNKGLNDISTIIKQELTEGRA HNAKTKPREEQQNSTYRVVSVLTVLHQDWLNG LALSHTYANVSISHVINLWGADFNAEGELEAI YVTDSDANPSIGMKKYFVGRNAHGVAISAKK IEGENIGAQVLGLFTLSSGKDIWQKLS (SEQ ID NO: 1154) |
| VRT-133 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFDYFR DKAFPNLSARQLGVMPDLV LDMFINGYYLNVGKTQSTD VNRPYQDKDKRGGIFDAVF TRGDQTTLLTARHDLKNKG NLLCGAATAGNMLHWWFDQNKTEIEAYLSKHP LNDISTIIKQELTEGRALA LSHTYANVSISHVINLWGA YFRDKAFPNLSARQLGVMPDLVLDMFINGYYL DFNAEGELEAIYVTDSDAN PSIGMKKYFVGRNAHGVA ISAKKIEGENIGAQVLGLF TLSSGKDQWQKLS (SEQ ID NO: 885) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD TRGDQTTLLTARHDLKNKGNLLCGAATAGNML HWWFDQNKTEIEAYLSKHPEKQKIIFGNQELF DLKAAIDTKDSQTNSQLFDYFRDKAFPNLSAR QLGVMPDLVLDMFINGYYLNVGKTQSTDVNRP YQDKDKRGGIFDAVFTRGDQTTLLTARHDLKN KGLNDISTIIKQELTEGRA LALSHTYANVSISHVINLWGADFNAEGELEAI YVTDSDANPSIGMKKYFVGRNAHGVAISAKK IEGENIGAQVLGLFTLSSGKDQWQKLS (SEQ ID NO: 1155) |
| VRT-134 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFNNQELFDLK AAIDTKDSQTNSQLFDYFR DKAFPNLSARQLGVMPDLV LDMFINGYYLNVFKTQSTD VNRPYQDKDKRGGIFDAVF TRGDQTTLLTARHDLKNKG LNDISTIIKQELTEGRALA DFNAEGELEAIYVTDSDAN PSIGMKKYFVGRNAHGVA ISAKKIEGENIGAQVLGLF TLSSGKDIWQKLS (SEQ ID NO: 886) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP VNRPYQDKDKRGGIFDAVF EQFRENNEDVIHAPYLAHQGWYDITKAFDGKD TRGDQTTLLTARHDLKNKGNLLCGAATAGNML HWWFDQNKTEIEAYLSKHP LSHTYANVSISHVINLWGA EKQKIIFNNQELFDLKAAIDTKDSQTNSQLFD YFRDKAFPNLSARQLGVMPDLVLDMFINGYYL NVFKTQSTDVNRPYQDKDKRGGIFDAVFTRGD QTTLLTARHDLKNKGLNDISTIIKQELTEGRA LALSHTYANVSISHVINLWGADFNAEGELEAI YVTDSDANPSIGMKKYFVGRNAHGVAISAKK IEGENIGAQVLGLFTLSSGKDIWQKLS (SEQ ID NO: 1156) |
| VRT-135 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR KNNEDVLHAPYVANQGWYD ITKTFDGKDNLLCGAATAG NMLHWWFDQNKEEIERYLK KHPEKQKIIFNNQELFDVK AAIDTKDSQTNSKLFNYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDIWQKLS (SEQ ID NO: 887) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRKNNEDVLHAPYVANQGWYDITKTFDGKD TRGDQTTLLTARHDLKNKGNLLCGAATAGNML HWWFDQNKEEIERYLKKHP EKQKIIFNNQELFDVKAAIDTKDSQTNSKLFN YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDIWQKLS (SEQ ID NO: 1157) |
| VRT-136 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFNYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD TRGDQTTLLTARHDLKNKGNLLCGAATAGNML HWWFDQNKEEIERYLKKHP LNEISDLIKQELTEGKALA EKQKIIFNNQELFDVKAAIDTKDSQTNSKLFN LSHTYANVRINHVINLWGA YFRDKAFPNLSARQLGVMPDLVLDMFINGYYL DFDAEGNLIAIYVTDSDAN NLGKTQSTDVNRPYQDKDKRGGIFDAVFTRGD |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | ASIGMKKYFVGRNANGKVA ISAKKIEGDNIGAQVLGLF TLSLGQDIWQKLS (SEQ ID NO: 888) | QTTLLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSLGQDIWQKLS (SEQ ID NO: 1158) |
| VRT-137 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR YNNEDVLHAPYVANQGWYD ITKTFDGKDNLLCGAATAG NMLHWWFDQNKEEIERYLK KEYKCKVSNKALKAPIEKTISKAKGQPREPQV KHPEKQKIIFNNQEWFDVK AAIDTKDSQTNSKLFDYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSLGQDIWQKLS (SEQ ID NO: 889) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRYNNEDVLHAPYVANQGWYDITKTFDGKD NLLCGAATAGNMLHWWFDQNKEEIERYLKKHP EKQKIIFNNQEWFDVKAAIDTKDSQTNSKLFD YFRDKAFPNLSARQLGVMPDLVLDMFINGYYL NLGKTQSTDVNRPYQDKDKRGGIFDAVFTRGD QTTLLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSLGQDIWQKLS (SEQ ID NO: 1159) |
| VRT-138 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KEYKCKVSNKALKAPIEKTISKAKGQPREPQV KHPEKQKIIFNNQELFDVK AAIDTKDSQTNSKLFDYFR DKAFPNLSARQLGVMPDLV LDMFINGYYLNLGKTQSTD VNRPYQDKDKRGGIFDAVF EDFRENNEDVLHAPYVANQGWYDITKTFDGKD TRGDQTTLLTARHDLKNKG LNEISDLIKQELTEGKALA EKQKIIFNNQELFDVKAAIDTKDSQTNSKLFD LSHTYANVRINHVINLWGA YFRDKAFPNLSARQLGVMPDLVLDMFINGYYL DFDAEGNLIAIYVTDSDAN NLGKTQSTDVNRPYQDKDKRGGIFDAVFTRGD ASIGMKKYFVGRNANGKVA QTTLLLTARHDLKNKGLNEISDLIKQELTEGKA ISAKKIEGDNIGAQVLGLF LALSHTYANVRINHVINLWGADFDAEGNLIAI TLSLGQDIWQKLS (SEQ ID NO: 890) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP YVTDSDANASIGMKKYFVGRNANGKVAISAKK IEGDNIGAQVLGLFTLSLGQDIWQKLS (SEQ ID NO: 1160) |
| VRT-139 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KEYKCKVSNKALKAPIEKTISKAKGQPREPQV KHPEKQKIIFGNQELFDVK AAIDTKDSQTNSKLFDYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDWQKLS (SEQ ID NO: 891) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFD YFRDKAFPNLSARQLGVMPDLVLDMFINGYYL NLGKTQSTDVNRPYQDKDKRGGIFDAVFTRGD QTTLLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDWQKLS (SEQ ID NO: 1161) |
| VRT-140 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPNLSARQLGVMPDLV LDMFINGYYLNLPKTQSTD VNRPYQDKDKRGGIFDAVF EDFRENNEDVLHAPYVANQGWYDITKTFDGKD TRGDQTTLLTARHDLKNKG LNEISDLIKQELTEGKALA LSHTYANVRINHVINLWGA DFDAEGNLIAIYVTDSDAN ASIGMKKYAVGVNANGKVA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP NLLCGAATAGNMLHWWFDQNKEEIERYLKKHP EKQKIIFGNQELFDVKAAIDTKDSQTNSKLFD YFRDKAFPNLSARQLGVMPDLVLDMFINGYYL NLPKTQSTDVNRPYQDKDKRGGIFDAVFTRGD QTTLLLTARHDLKNKGLNEISDLIKQELTEGKA |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | ISAKKIEGDNIGAQVLGLF TLSTGQDQWQKLS (SEQ ID NO: 892) | LALSHTYANVRINHVINLWGADFDAEGNLIAI YVTDSDANASIGMKKYAVGVNANGKVAISAKK IEGDNIGAQVLGLFTLSTGQDQWQKLS (SEQ ID NO: 1162) |
| VRT-141 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFDYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDQWQKLS (SEQ ID NO: 893) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQELFDVKAAIDTKDSQTNSKLFD YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDQWQKLS (SEQ ID NO: 1163) |
| VRT-142 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQEWFDVK AAIDTKDSQTNSKLFNYFR DKAFPNLSARQLGVMPDLV LDMFINGYYLNLPKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF TLSTGQDIWQKLS (SEQ ID NO: 894) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQEWFDVKAAIDTKDSQTNSKLFN YFRDKAFPNLSARQLGVMPDLVLDMFINGYYL NLPKTQSTDVNRPYQDKDKRGGIFDAVFTRGD ASIGMKKYAVGVNANGKVAQTTLLTARHDLKNKGLNEISDLIKQELTEGKA LALSHTYANVRINHVINLWGADFDAEGNLIAI YVTDSDANASIGMKKYAVGVNANGKVAISAKK IEGDNIGAQVLGLFTLSTGQDIWQKLS (SEQ ID NO: 1164) |
| VRT-143 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DFDAEGNLIAIYVTDSDAN PSIGMKKYFVGRNANGKVA ISAKKIEGDNIGAQVLGLF TLSTGQDIWQKLS (SEQ ID NO: 895) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGNLIAI YVTDSDANPSIGMKKYFVGRNANGKVAISAKK IEGDNIGAQVLGLFTLSTGQDIWQKLS (SEQ ID NO: 1165) |
| VRT-144 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA LSHTYANVRINHVINLWGA DEDAEGELIAIYVTDSDAN PSIGMKKYFVGRNANGKVA ISAKKIEGDNIGAQVLGLF | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFD YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGELIAI |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | TLSTGQDIWQKLS (SEQ ID NO: 896) | YVTDSDANPSIGMKKYFVGRNANGKVAISAKK IEGDNIGAQVLGLFTLSTGQDIWQKLS (SEQ ID NO: 1166) |
| VRT-145 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPNLSARQLGVMPDLV LDMFINGYYLNLGKTQSTD VNRPYQDKDKRGGIFDAVF TRGDQTTLLLTARHDLKNKG LNEISDLIKQELTEGKALA LSHTYANVRINHVINLWGA DFDAEGELIAIYVTDSDAN PSIGMKKYFVGRNANGKVA ISAKKIEGDNIGAQVLGLF TLSTGQDQWQKLS (SEQ ID NO: 897) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFD YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGELIAI YVTDSDANPSIGMKKYFVGRNANGKVAISAKK IEGDNIGAQVLGLFTLSTGQDQWQKLS (SEQ ID NO: 1167) |
| VRT-146 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFDYFR DKAFPNLSARQLGVMPDLV LDMFINGYYLNLGKTQSTD VNRPYQDKDKRGGIFDAVF TRGDQTTLLLTARHDLKNKG LNEISDLIKQELTEGKALA LSHTYANVRINHVINLWGA DFDAEGELIAIYVTDSDAN PSIGMKKYFVGRNANGKVA ISAKKIEGDNIGAQVLGLF TLSTGQDIWQKLS (SEQ ID NO: 898) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQELFDVKAAIDTKDSQTNSKLFD YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVRINHVINLWGADFDAEGELIAI YVTDSDANPSIGMKKYFVGRNANGKVAISAKK IEGDNIGAQVLGLFTLSTGQDIWQKLS (SEQ ID NO: 1168) |
| VRT-147 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR KNNEDVLHAPYVANQGWYD ITKTFDGKDNLLCGAATAG NMLHWWFDQNKEEIERYLK KHPEKQKIIFNNQELFDVK AAIDTKDSQTNSKLFNYFR DKAFPGLSARQLGVFPDLV LDMFINGYYLNLGKTQSTD VNRPYQDKDKRGGIFDAVF TRGVQTTLLTARHDLKNKG NLLCGAATAGNMLHWWFDQ LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDIWQKLS (SEQ ID NO: 899) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRKNNEDVLHAPYVANQGWYDITKTFDGKD NLLCGAATAGNMLHWWFDQNKEEIERYLKKHP EKQKIIFNNQELFDVKAAIDTKDSQTNSKLFN YFRDKAFPGLSARQLGVFPDLVLDMFINGYYL NLGKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDIWQKLS (SEQ ID NO: 1169) |
| VRT-148 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFNYFR DKAFPGLSARQLGVFPDLV LDMFINGYYLNLGKTQSTD VNRPYQDKDKRGGIFDAVF | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD |

TABLE 8-continued

| ID | N-terminus Fc Moiety | Linker | C-terminus Protease Moiety | Full length Sequence |
|---|---|---|---|---|
| | QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | TRGVQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSLGQDIWQKLS (SEQ ID NO: 900) | NLLCGAATAGNMLHWWFDQNKEEIERYLKKHP EKQKIIFNNQELFDVKAAIDTKDSQTNSKLFN YFRDKAFPGLSARQLGVFPDLVLDMFINGYYL NLGKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSLGQDIWQKLS (SEQ ID NO: 1170) |
| VRT-149 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPGLSARQLGVFPDLV LDMFINGYYLNLGKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDWQKLS (SEQ ID NO: 901) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQELFDVKAAIDTKDSQTNSKLFD LSHTYANVRINHVINLWGAYFRDKAFPGLSARQLGVFPDLVLDMFINGYYL DFDAEGNLIAIYVTDSDANNLGKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDWQKLS (SEQ ID NO: 1171) |
| VRT-150 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFDYFR DKAFPGLSARQLGVFPDLV LDMFINGYYLNLGKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYFVGRNANGKVA ISAKKIEGDNIGAQVLGLF TLSTGQDWQKLS (SEQ ID NO: 902) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQELFDVKAAIDTKDSQTNSKLFD LSHTYANVRINHVINLWGAYFRDKAFPGLSARQLGVFPDLVLDMFINGYYL DFDAEGNLIAIYVTDSDANNLGKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYFVGRNANGKVAISAKK IEGDNIGAQVLGLFTLSTGQDWQKLS (SEQ ID NO: 1172) |
| VRT-151 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQEWFDVK AAIDTKDSQTNSKLFNYFR DKAFPGLSARQLGVFPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF TLSTGQDIWQKLS (SEQ ID NO: 903) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFNNQEWFDVKAAIDTKDSQTNSKLFN LSHTYANVRINHVINLWGAYFRDKAFPGLSARQLGVFPDLVLDMFINGYYL DFDAEGNLIAIYVTDSDANNLPKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYAVGVNANGKVAISAKK IEGDNIGAQVLGLFTLSTGQDIWQKLS (SEQ ID NO: 1173) |
| VRT-152 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFR DKAFPGLSARQLGVFPDLV LDMFINGYYLNLGKTQSTD VNRPYQDKDKRGGIFDAVF TRGVQTTLLTARHDLKNKG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP |

TABLE 8-continued

| ID | N-terminus Fc Moiety | Linker | C-terminus Protease Moiety | Full length Sequence |
|---|---|---|---|---|
| | NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | LNEISDLIKQELTEGKALA LSHTYANVRINHVINLWGA DFDAEGNLIAIYVTDSDAN PSIGMKKYFVGRNANGKVA ISAKKIEGDNIGAQVLGLF TLSTGQDIWQKLS (SEQ ID NO: 904) | EKQKIIFGNQELFDVKAAIDTKDSQTNSKLFN YFRDKAFPGLSARQLGVFPDLVLDMFINGYYL NLGKTQSTDVNRPYQDKDKRGGIFDAVFTRGV QTTLLLTARHDLKNKGLNEISDLIKQELTEGKA LALSHTYANVRINHVINLWGADFDAEGNLIAI YVTDSDANPSIGMKKYFVGRNANGKVAISAKK IEGDNIGAQVLGLFTLSTGQDIWQKLS (SEQ ID NO: 1174) |
| VRT-153 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPGLSARQLGVFPDLV LDMFINGYYLNLGKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGELIAIYVTDSDAN PSIGMKKYFVGRNANGKVA ISAKKIEGDNIGAQVLGLF TLSTGQDIWQKLS (SEQ ID NO: 905) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP LNEISDLIKQELTEGKALAEKQKIIFGNQELFDVKAAIDTKDSQTNSKLFD LSHTYANVRINHVINLWGAYFRDKAFPGLSARQLGVFPDLVLDMFINGYYL DFDAEGELIAIYVTDSDANNLGKTQSTDVNRPYQDKDKRGGIFDAVFTRGV PSIGMKKYFVGRNANGKVAQTTLLLTARHDLKNKGLNEISDLIKQELTEGKA ISAKKIEGDNIGAQVLGLFLALSHTYANVRINHVINLWGADFDAEGELIAI TLSTGQDIWQKLS (SEQ ID NO: 905)YVTDSDANPSIGMKKYFVGRNANGKVAISAKK IEGDNIGAQVLGLFTLSTGQDIWQKLS (SEQ ID NO: 1175) |
| VRT-154 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFDYFR DKAFPGLSARQLGVFPDLV LDMFINGYYLNLGKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGELIAIYVTDSDAN PSIGMKKYFVGRNANGKVA ISAKKIEGDNIGAQVLGLF TLSTGQDQWQKLS (SEQ ID NO: 906) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP LNEISDLIKQELTEGKALAEKQKIIFGNQELFDVKAAIDTKDSQTNSKLFD LSHTYANVRINHVINLWGAYFRDKAFPGLSARQLGVFPDLVLDMFINGYYL DFDAEGELIAIYVTDSDANNLGKTQSTDVNRPYQDKDKRGGIFDAVFTRGV PSIGMKKYFVGRNANGKVAQTTLLLTARHDLKNKGLNEISDLIKQELTEGKA ISAKKIEGDNIGAQVLGLFLALSHTYANVRINHVINLWGADFDAEGELIAI TLSTGQDQWQKLS (SEQ ID NO: 906)YVTDSDANPSIGMKKYFVGRNANGKVAISAKK IEGDNIGAQVLGLFTLSTGQDQWQKLS (SEQ ID NO: 1176) |
| VRT-155 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFNNQELFDVK AAIDTKDSQTNSKLFDYFR DKAFPGLSARQLGVFPDLV LDMFINGYYLNLGKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGELIAIYVTDSDAN PSIGMKKYFVGRNANGKVA ISAKKIEGDNIGAQVLGLF TLSTGQDIWQKLS (SEQ ID NO: 907) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP LNEISDLIKQELTEGKALAEKQKIIFNNQELFDVKAAIDTKDSQTNSKLFD LSHTYANVRINHVINLWGAYFRDKAFPGLSARQLGVFPDLVLDMFINGYYL DFDAEGELIAIYVTDSDANNLGKTQSTDVNRPYQDKDKRGGIFDAVFTRGV PSIGMKKYFVGRNANGKVAQTTLLLTARHDLKNKGLNEISDLIKQELTEGKA ISAKKIEGDNIGAQVLGLFLALSHTYANVRINHVINLWGADFDAEGELIAI TLSTGQDIWQKLS (SEQ ID NO: 907)YVTDSDANPSIGMKKYFVGRNANGKVAISAKK IEGDNIGAQVLGLFTLSTGQDIWQKLS (SEQ ID NO: 1177) |
| VRT-156 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | TITSVWTKGVTPPTPEDFR KNNEDVLHAPYLANQGWYD ITKAFDGKDNLLCGAATAG NMLHWWFDQNKEEIERYLK KHPEKQKIIFNNQELFDVK AAIDTKDSQTNSKLFNYFR DKAFPNLSARQLGVMPDLV LDMFINGYYLNLGKTQSTD VNRPYQDKDKRGGIFDAVF TRGDQTTLLTARHDLKNKG LNEISDLIKQELTEGKALA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRKNNEDVLHAPYLANQGWYDITKAFDGKD NLLCGAATAGNMLHWWFDQNKEEIERYLKKHP LNEISDLIKQELTEGKALAEKQKIIFNNQELFDVKAAIDTKDSQTNSKLFN |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | LSHTYANVSINHVINLWGA DFDAEGNLEAIYVTDSDAN ASIGMKKYFVGRNAHGKVA ISAKKIEGDNIGAQVLGLF TLSTGQDIWQKLS (SEQ ID NO: 908) | YFRDKAFPNLSARQLGVMPDLVLDMFINGYYL NLGKTQSTDVNRPYQDKDKRGGIFDAVFTRGD QTTLLTARHDLKNKGLNEISDLIKQELTEGKA LALSHTYANVSINHVINLWGADFDAEGNLEAI YVTDSDANASIGMKKYFVGRNAHGKVAISAKK IEGDNIGAQVLGLFTLSTGQDIWQKLS (SEQ ID NO: 1178) |
| VRT-157 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ISRTPEVTCVVVDVSHEDPEVKFNWYVDGVEV ITKAFDGKDNLLCGAATAG HNAKTKPREEQQNSTYRVVSVLTVLHQDWLNG NMLHWWFDQNKEEIERYLK KEYKCKVSNKALKAPIEKTISKAKGQPREPQV KHPEKQKIIFNNQELFDVK YTLPPSRDELTKNQVSLTCLVKGFYPSDIAVE AAIDTKDSQTNSKLFNYFR WESNGQPENNYKTTPPVLDSDGSFFLYSKLTV DKAFPNLSARQLGVMPDLV DKSRWQQGNVFSCSVMHEALHNHYTQKSLSLS LDMFINGYYLNLGKTQSTD PGGGGSGGGGSGGGGSGTITSVWTKGVTPPTP VNRPYQDKDKRGGIFDAVF EDFRENNEDVLHAPYLANQGWYDITKAFDGKD TRGDQTTLLTARHDLKNKG NLLCGAATAGNMLHWWFDQNKEEIERYLKKHP LNEISDLIKQELTEGKALA EKQKIIFNNQELFDVKAAIDTKDSQTNSKLFN LSHTYANVSINHVINLWGA YFRDKAFPNLSARQLGVMPDLVLDMFINGYYL DFDAEGNLEAIYVTDSDAN NLGKTQSTDVNRPYQDKDKRGGIFDAVFTRGD ASIGMKKYFVGRNAHGKVA QTTLLTARHDLKNKGLNEISDLIKQELTEGKA ISAKKIEGDNIGAQVLGLF LALSHTYANVSINHVINLWGADFDAEGNLEAI TLSLGQDIWQKLS (SEQ YVTDSDANASIGMKKYFVGRNAHGKVAISAKK ID NO: 909) IEGDNIGAQVLGLFTLSLGQDIWQKLS (SEQ ID NO: 1179) |
| VRT-158 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ISRTPEVTCVVVDVSHEDPEVKFNWYVDGVEV ITKAFDGKDNLLCGAATAG HNAKTKPREEQQNSTYRVVSVLTVLHQDWLNG NMLHWWFDQNKEEIERYLK KEYKCKVSNKALKAPIEKTISKAKGQPREPQV KHPEKQKIIFGNQELFDVK YTLPPSRDELTKNQVSLTCLVKGFYPSDIAVE AAIDTKDSQTNSKLFDYFR WESNGQPENNYKTTPPVLDSDGSFFLYSKLTV DKAFPNLSARQLGVMPDLV DKSRWQQGNVFSCSVMHEALHNHYTQKSLSLS LDMFINGYYLNLGKTQSTD PGGGGSGGGGSGGGGSGTITSVWTKGVTPPTP VNRPYQDKDKRGGIFDAVF EDFRENNEDVLHAPYLANQGWYDITKAFDGKD TRGDQTTLLTARHDLKNKG NLLCGAATAGNMLHWWFDQNKEEIERYLKKHP LNEISDLIKQELTEGKALA EKQKIIFGNQELFDVKAAIDTKDSQTNSKLFD LSHTYANVSINHVINLWGA YFRDKAFPNLSARQLGVMPDLVLDMFINGYYL DFDAEGNLEAIYVTDSDAN NLGKTQSTDVNRPYQDKDKRGGIFDAVFTRGD ASIGMKKYFVGRNAHGKVA QTTLLTARHDLKNKGLNEISDLIKQELTEGKA ISAKKIEGDNIGAQVLGLF LALSHTYANVSINHVINLWGADFDAEGNLEAI TLSTGQDWQKLS (SEQ YVTDSDANASIGMKKYFVGRNAHGKVAISAKK ID NO: 910) IEGDNIGAQVLGLFTLSTGQDWQKLS (SEQ ID NO: 1180) |
| VRT-159 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ISRTPEVTCVVVDVSHEDPEVKFNWYVDGVEV ITKAFDGKDNLLCGAATAG HNAKTKPREEQQNSTYRVVSVLTVLHQDWING NMLHWWFDQNKEEIERYLK KEYKCKVSNKALKAPIEKTISKAKGQPREPQV KHPEKQKIIFNNQELFDVK YTLPPSRDELTKNQVSLTCLVKGFYPSDIAVE AAIDTKDSQTNSKLFDYFR WESNGQPENNYKTTPPVLDSDGSFFLYSKLTV DKAFPNLSARQLGVMPDLV DKSRWQQGNVFSCSVMHEALHNHYTQKSLSLS LDMFINGYYLNLGKTQSTD PGGGGSGGGGSGGGGSGTITSVWTKGVTPPTP VNRPYQDKDKRGGIFDAVF EDFRENNEDVLHAPYLANQGWYDITKAFDGKD TRGDQTTLLTARHDLKNKG NLLCGAATAGNMLHWWFDQNKEEIERYLKKHP LNEISDLIKQELTEGKALA EKQKIIFNNQELFDVKAAIDTKDSQTNSKLFD LSHTYANVSINHVINLWGA YFRDKAFPNLSARQLGVMPDLVLDMFINGYYL DFDAEGNLEAIYVTDSDAN NLGKTQSTDVNRPYQDKDKRGGIFDAVFTRGD ASIGMKKYFVGRNAHGKVA QTTLLTARHDLKNKGLNEISDLIKQELTEGKA ISAKKIEGDNIGAQVLGLF LALSHTYANVSINHVINLWGADFDAEGNLEAI TLSTGQDWQKLS (SEQ YVTDSDANASIGMKKYFVGRNAHGKVAISAKK ID NO: 911) IEGDNIGAQVLGLFTLSTGQDWQKLS (SEQ ID NO: 1181) |
| VRT-160 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | TITSVWTKGVTPPTPEDFR ENNEDVLHAPYLANQGWYD ISRTPEVTCVVVDVSHEDPEVKFNWYVDGVEV ITKAFDGKDNLLCGAATAG HNAKTKPREEQQNSTYRVVSVLTVLHQDWLNG NMLHWWFDQNKEEIERYLK KEYKCKVSNKALKAPIEKTISKAKGQPREPQV KHPEKQKIIFNNQEWFDVK YTLPPSRDELTKNQVSLTCLVKGFYPSDIAVE AAIDTKDSQTNSKLFNYFR WESNGQPENNYKTTPPVLDSDGSFFLYSKLTV DKAFPNLSARQLGVMPDLV DKSRWQQGNVFSCSVMHEALHNHYTQKSLSLS LDMFINGYYLNLPKTQSTD PGGGGSGGGGSGGGGSGTITSVWTKGVTPPTP VNRPYQDKDKRGGIFDAVF EDFRENNEDVLHAPYLANQGWYDITKAFDGKD TRGDQTTLLTARHDLKNKG NLLCGAATAGNMLHWWFDQNKEEIERYLKKHP LNEISDLIKQELTEGKALA EKQKIIFNNQEWFDVKAAIDTKDSQTNSKLFN LSHTYANVSINHVINLWGA YFRDKAFPNLSARQLGVMPDLVLDMFINGYYL |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | DFDAEGNLEAIYVTDSDAN ASIGMKKYAVGVNAHGKVA ISAKKIEGDNIGAQVLGLF TLSTGQDIWQKLS (SEQ ID NO: 912) | NLPKTQSTDVNRPYQDKDKRGGIFDAVFTRGD QTTLLTARHDLKNKGLNEISDLIKQELTEGKA HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKAFPNLSARQLGVMPDLVLDMFINGYYLNLG KTQSTDPGGGGSGGGGSGGGGSGTITSVWTKG VTPPTPEDFRENNEDVLHAPYLANQGWYDITK AFDGKDNLLCGAATAGNMLHWWFDQNKEEIER YLKKHPLNEISDLIKQELTEGKALEKQKIIFG NQELFDVKAAIDTKDSQTNSKLFYNFRWESNG QPENNYKTTPPVLDSDGSFFLYSKLTVDKAFP NLSARQLGVMPDLVLDMFINGYYLNLGKTQST DPGGGGSGGGGSGGGGSGTITSVWTKGVTPPT PEDFRENNEDVLHAPYLANQGWYDITKAFDGK DNLLCGAATAGNMLHWWFDQNKEEIERYLKKH PLNEISDLIKQELTEGKALEKQKIIFGNQELF DVKAAIDTKDSQTNSKLFDLSHTYANVSINHV INLWGAYFRDKAFPNLSARQLGVMPDLVLDMF INGYYLDFDAEGNLEAIYVTDSDANLGKTQST DVNRPYQDKDKRGGIFDAVFTRGDQTTLLTAR HDLKNKGNLLCGAATAGNMLHWWFDQNKEEIE RYLKKHPLNEISDLIKQELTEGKALALSHTYA NVSINHVINLWGADFDAEGNLEAI YVTDSDANASIGMKKYAVGVNAHGKVAISAKK IEGDNIGAQVLGLFTLSTGQDIWQKLS (SEQ ID NO: 1182) |
| VRT-161 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFR WESNGQPENNYKTTPPVLD SDGSFFLYSKLTVDKAFPN LSARQLGVMPDLVLDMFIN GYYLNLGKTQSTDPGGGGS GGGGSGGGGSGTITSVWTK GVTPPTPEDFRENNEDVLH APYLANQGWYDITKAFDGK DNLLCGAATAGNMLHWWFD QNKEEIERYLKKHPLNEIS DLIKQELTEGKALEKQKII FGNQELFDVKAAIDTKDSQ TNSKLFDLSHTYANVSINH VINLWGAYFRDKAFPNLSA RQLGVMPDLVLDMFINGYY LDFDAEGNLEAIYVTDSDAN PSIGMKKYFVGRNAHGKVA ISAKKIEGDNIGAQVLGLF TLSTGQDIWQKLS (SEQ ID NO: 913) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALAEKQKIIFGNQELFDVKAAIDTKDSQTNSKLFD LSHTYANVSINHVINLWGAYFRDKAFPNLSARQLGVMPDLVLDMFINGYYL DFDAEGNLEAIYVTDSDANPSIGMKKYFVGRNAHGKVA QTTLLTARHDLKNKGLNEISDLIKQELTEGKA LALSHTYANVSINHVINLWGADFDAEGNLEAI YVTDSDANPSIGMKKYFVGRNAHGKVAISAKK IEGDNIGAQVLGLFTLSTGQDIWQKLS (SEQ ID NO: 1183) |
| VRT-162 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFDYFR WESNGQPENNYKTTPPVLD SDGSFFLYSKLTVDKAFPN LSARQLGVMPDLVLDMFIN GYYLNLGKTQSTDPGGGGS GGGGSGGGGSGTITSVWTK GVTPPTPEDFRENNEDVLH APYLANQGWYDITKAFDGK DNLLCGAATAGNMLHWWFD QNKEEIERYLKKHPLNEIS DLIKQELTEGKALEKQKII FGNQELFDVKAAIDTKDSQ TNSKLFDLSHTYANVSINH VINLWGAYFRDKAFPNLSA RQLGVMPDLVLDMFINGYY LDFDAEGELEAIYVTDSDAN PSIGMKKYFVGRNAHGKVA ISAKKIEGDNIGAQVLGLF TLSTGQDIWQKLS (SEQ ID NO: 914) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALEKQKIIFGNQELFD VKAAIDTKDSQTNSKLFDLSHTYANVSINHVINLWGA YFRDKAFPNLSARQLGVMPDLVLDMFINGYYL DFDAEGELEAIYVTDSDANPSIGMKKYFVGRNAHGKVA QTTLLTARHDLKNKGLNEISDLIKQELTEGKA LALSHTYANVSINHVINLWGADFDAEGELEAI YVTDSDANPSIGMKKYFVGRNAHGKVAISAKK IEGDNIGAQVLGLFTLSTGQDIWQKLS (SEQ ID NO: 1184) |
| VRT-163 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFDYFR WESNGQPENNYKTTPPVLD SDGSFFLYSKLTVDKAFPN LSARQLGVMPDLVLDMFIN GYYLNLGKTQSTDPGGGGS GGGGSGGGGSGTITSVWTK GVTPPTPEDFRENNEDVLH APYLANQGWYDITKAFDGK DNLLCGAATAGNMLHWWFD QNKEEIERYLKKHPLNEIS DLIKQELTEGKALEKQKII FGNQELFDVKAAIDTKDSQ TNSKLFDLSHTYANVSINH VINLWGAYFRDKAFPNLSA RQLGVMPDLVLDMFINGYY LDFDAEGELEAIYVTDSDAN PSIGMKKYFVGRNAHGKVA ISAKKIEGDNIGAQVLGLF TLSTGQDQWQKLS (SEQ ID NO: 915) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALEKQKIIFGNQELFD VKAAIDTKDSQTNSKLFDLSHTYANVSINHVINLWGA YFRDKAFPNLSARQLGVMPDLVLDMFINGYYL DFDAEGELEAIYVTDSDANPSIGMKKYFVGRNAHGKVA QTTLLTARHDLKNKGLNEISDLIKQELTEGKA LALSHTYANVSINHVINLWGADFDAEGELEAI YVTDSDANPSIGMKKYFVGRNAHGKVAISAKK IEGDNIGAQVLGLFTLSTGQDQWQKLS (SEQ ID NO: 1185) |
| VRT-164 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | | | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPT PEDFRENNEDVLHAPYLANQGWYDITKAFDGKD NLLCGAATAGNMLHWWFDQNKEEIERYLKKHP LNEISDLIKQELTEGKALEKQKIIFNQELFD VKAAIDTKDSQTNSKLFDLSHTYANVSINHVINLWGA YFRDKAFPNLSARQLGVMPDLVLDMFINGYYL DFDAEGELEAIYVTDSDANLGKTQSTDVNRPYQDKDKRGGIFDAVFTRGD |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | PSIGMKKYFVGRNAHGKVA ISAKKIEGDNIGAQVLGLF TLSTGQDIWQKLS (SEQ ID NO: 916) | QTTLLLTARHDLKNKGLNEISDLIKQELTEGKA LALSHTYANVSINHVINLWGADFDAEGELEAI YVTDSDANPSIGMKKYFVGRNAHGKVAISAKK IEGDNIGAQVLGLFTLSTGQDIWQKLS (SEQ ID NO: 1186) |
| VRT-165 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEMQNVVYTKWLDGVDV KDHDFRKIVDGNSAYYATP LLNGRGFYDINKDFNRDSD KCAAAVAANMFHYWLDINR DNVDRFLRQNPEKHGIIEL PDGQLKLSDFLNTYESDHG YRDKSKLFDFISNNFNGPV WTDKLLDNYINGYAYNYKY GRTIEDPTKNTSKINFFKE VFNEKILTNNHSIRNQNEF SVLLSEALYTGKAIGLSYG PAGLRHSLGHIISVWGADL ISNNFNGPVWTDKLLDNYI NGYAYNYKYGRTIDADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 917) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEMQNVVYTKWLDGVDVKDHDFRKIV DGNSAYYATPLLNGRGFYDINKDFNRDSDKCA AAVAANMFHYWLDINRDNVDRFLRQNPEKHGI IELPDGQLKLSDFLNTYESDHGYRDKSKLFDF ISNNFNGPVWTDKLLDNYINGYAYNYKYGRTI EDPTKNTSKINFFKEVFNEKILTNNHSIRNQN EFSVLLSEALYTGKAIGLSYGPAGLRHSLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1187) |
| VRT-166 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEMQNVVYTKWLDGVDV KDHDFRKIVDGNSAYYATP LLNGRGWYDINKDFNRDSD KCAAAVAANMFHYWLDINR DNVDRFLRQNPEKHGIIEL PDGQLKLSDFLNTYESDHG YRDKSKLFDFISNNFNGPV WTDKLLDNYINGYAYNYKY GRTIEDPTKNTSKINFFKE VFNEKILTNNHSIRNQNEF SVLLSEALYTGKAIGLSYG PAGLRHSLGHIISVWGADL ISNNFNGPVWTDKLLDNYI NGYAYNYKYGRTIDADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 918) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEMQNVVYTKWLDGVDVKDHDFRKIV DGNSAYYATPLLNGRGWYDINKDFNRDSDKCA AAVAANMFHYWLDINRDNVDRFLRQNPEKHGI IELPDGQLKLSDFLNTYESDHGYRDKSKLFDF ISNNFNGPVWTDKLLDNYINGYAYNYKYGRTI EDPTKNTSKINFFKEVFNEKILTNNHSIRNQN EFSVLLSEALYTGKAIGLSYGPAGLRHSLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1188) |
| VRT-167 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGWYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNYKY GRTIEDPTKNTSKINFFKE VFNEKILTNNHSIRNQNEF SVLLIEALYTGKAIGLSYG PAGLRHSLGHIISVWGADL ISENFNGPVWTDKLLDNYI NGYAYNYKYGRTIDADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 919) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNIAYYATPLLNGRGWYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNYKYGRTI EDPTKNTSKINFFKEVFNEKILTNNHSIRNQN EFSVLLIEALYTGKAIGLSYGPAGLRHSLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1189) |
| VRT-168 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGLYDINKDFNRDSD KCAAAVAANMFHYWLDINR DNVDRFLRQNPEKHGIIEL PDGQLKLSDFLNTYESDHG YRDKSKLFDFISNNFNGPV WTDKLLDNYINGYAYNYKY GRTIEDPTKNTSKINFFKE VFNEKILTNNHSIRNQNEL | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNIAYYATPLLNGRGLYDINKDFNRDSDKCA AAVAANMFHYWLDINRDNVDRFLRQNPEKHGI |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | SVLLSEALYTGKAIGLSYG PAGLRHSLGHIISVWGADL DADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 920) | IELPDGQLKLSDFLNTYESDHGYRDKSKLFDF ISENFNGPVWTDKLLDNYINGYAYNYKYGRTI EDPTKNTSKINFFKEVFNEKILTNNHSIRNQN TIGDERVGLKRYKISTDDE ELSVLLSEALYTGKAIGLSYGPAGLRHSLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1190) |
| VRT-169 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNSAYYATP LLNGRGWYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNYKY GRTIEDPTKNTSKINFFKE VFNEKILTNNHSIRNQNEF AAVAANMFHYWLDINRDNVDRFLRQNPEKHGI SVLLIEALYTGKAIGLSYG PAGLRHSLGHIISVWGADL DADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 921) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNSAYYATPLLNGRGWYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNYKYGRTI EDPTKNTSKINFFKEVFNEKILTNNHSIRNQN EFSVLLIEALYTGKAIGLSYGPAGLRHSLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1191) |
| VRT-170 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNYKY GRTIEDPTKNTSKINFFKE VFNEKILTNNHSIRNQNEF AAVAANMFHYWLDINRDNVDRFLRQNPEKHGI SVLLIEALYTGKAIGLSYG PAGLRHSLGHIISVWGADL DADGNVVAIYVTDSDDKKL TIGDERVGLKRYKISTDDE NRLRLTAYEETHNTGGQIR GLWTLDTGKYAWADYFDKT EQTGTDQAEQ (SEQ ID NO: 922) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNYKYGRTI EDPTKNTSKINFFKEVFNEKILTNNHSIRNQN EFSVLLIEALYTGKAIGLSYGPAGLRHSLGHI ISVWGADLDADGNVVAIYVTDSDDKKLTIGDE RVGLKRYKISTDDENRLRLTAYEETHNTGGQI RGLWTLDTGKYAWADYFDKTEQTGTDQAEQ (SEQ ID NO: 1192) |
| VRT-171 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNSKY GRTIEDPTKNTSKINFFKE VFNEKILTNNHSIRNQNEF AAVAANMFHYWLDINRDNVDRFLRQNPEKHGI SVLLIEALYTGKAIGLSYG PAGLRHGLGHIISVWGADL DADGNVVAIYVTDSDDKKL TIGDERVGLKRYKISTDDE NRLRLTAYEETHNTGGQIR GLWTLDTGKYAWADYFDKT EQTGTDQAEQ (SEQ ID NO: 923) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNSKYGRTI EDPTKNTSKINFFKEVFNEKILTNNHSIRNQN EFSVLLIEALYTGKAIGLSYGPAGLRHSLGHI ISVWGADLDADGNVVAIYVTDSDDKKLTIGDE RVGLKRYKISTDDENRLRLTAYEETHNTGGQI RGLWTLDTGKYAWADYFDKTEQTGTDQAEQ (SEQ ID NO: 1193) |
| VRT-172 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI | GGGGSGG GGSGGGG SG (SEQ ID NO: 1020) | SQTEDSESLQRLRDIEDFQ AEKEMQNVVYTKWLDGVDV KDHDFRKIVDGNSAYYATP LLNGRGWYDINKDFNRDSD KCAAAVAANMFHYWLDINR DNVDRFLRQNPEKHGIIEL PDGQLKLSDFLNTYESDHG YRDKSKLFDFISENFNGPV | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI |

TABLE 8-continued

| ID | N-terminus Fc Moiety | Linker | C-terminus Protease Moiety | Full length Sequence |
|---|---|---|---|---|
| | EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | WTDKLLDNYINGYAYNSKY GRTIEDPTKNTSKINFFKE VFNEKILTNNHSIRNQNEF SVLLIEALYTGKAIGLSYG PAGLRHGLGHIISVWGADL DADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 924) | EDFQAEKEMQNVVYTKWLDGVDVKDHDFRKIV DGNSAYYATPLLNGRGWYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNSKYGRTI EDPTKNTSKINFFKEVFNEKILTNNHSIRNQN TIGDERVGLKRYKISTDDEEFSVLLIEALYTGKAIGLSYGPAGLRHGLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1194) |
| VRT-173 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNEAYYATP LLNGRGFYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNYKY GRTIEDPTKNTSKINFFKE VFNEKILTNNHSIRNQNEL SVLLSEALYTGKAIGLSYG PAGLRHSLGHIISVWGADL DADGNVVAIYVTDSDDKKL TIGDERVGLKRYKISTDDE NRLRLTAYEETHNTGGQIR GLWTLDTGKYAWADYFDKT EQTGTDQAEQ (SEQ ID NO: 925) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNEAYYATPLLNGRGFYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNYKYGRTI EDPTKNTSKINFFKEVFNEKILTNNHSIRNQN TIGDERVGLKRYKISTDDEELSVLLSEALYTGKAIGLSYGPAGLRHSLGHI ISVWGADLDADGNVVAIYVTDSDDKKLTIGDE RVGLKRYKISTDDENRLRLTAYEETHNTGGQI RGLWTLDTGKYAWADYFDKTEQTGTDQAEQ (SEQ ID NO: 1195) |
| VRT-174 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNEAYYATP LLNGRGFYDINKDFNRDSD KCAAAVAANMFHYWLDINR DNVDRFLRQNPEKHGIIEL PDGQLKLSDFLNTYESDHG YRDKSKLFDFISENFNGPV WTDKLLDNYINGYAYNYKY GRLIEDPTKNTSKINFFKE VFNEKILTNNHSIRNQNEL SVLLSEALYTGKAIGLSYG PAGTRHSLGHIISVWGADL DADGNVVAIYVTDSDDKKL TIGDERVGLKRYKISTDDE NRLRLTAYEETHNTGGQIR GLWTLDTGKYAWADYFDKT EQTGTDQAEQ (SEQ ID NO: 926) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNEAYYATPLLNGRGFYDINKDFNRDSDKCA AAVAANMFHYWLDINRDNVDRFLRQNPEKHGI IELPDGQLKLSDFLNTYESDHGYRDKSKLFDF ISENFNGPVWTDKLLDNYINGYAYNYKYGRLI EDPTKNTSKINFFKEVFNEKILTNNHSIRNQN TIGDERVGLKRYKISTDDEELSVLLSEALYTGKAIGLSYGPAGTRHSLGHI ISVWGADLDADGNVVAIYVTDSDDKKLTIGDE RVGLKRYKISTDDENRLRLTAYEETHNTGGQI RGLWTLDTGKYAWADYFDKTEQTGTDQAEQ (SEQ ID NO: 1196) |
| VRT-175 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGFYDINKDFNRDSD KCAAAVAANMFHYWLDRNR DNVDRFLRQNPEKHGIIEL PDGQLKLSDFLNTYESDDG YRDKSKLFDFISNNFNGPV WTDKLLDNYINGYAYNYKY GRTIEDPTKNTSKINFFKE VFNEKILTNNHSIRNQNEF SVLLSEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 927) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEKQNVVYTKWLDGVDVKDHDFRKIV DGNSAYYATPLLNGRGFYDINKDFNRDSDKCA AAVAANMFHYWLDRNRDNVDRFLRQNPEKHGI IELPDGQLKLSDFLNTYESDDGYRDKSKLFDF ISNNFNGPVWTDKLLDNYINGYAYNYKYGRTI EDPTKNTSKINFFKEVFNEKILTNNHSIRNQN TIGDERVGLKRYKISTDDEEFSVLLSEALYTGKAIGLSYGPAGLRHSLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1197) |
| VRT-176 | DKTHTCPPCPAPEA AGAPSVFLFPPKPK DTLMISRTPEVTCV VVDVSHEDPEVKFN WYVDGVEVHNAKTK | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGWYDINKDFNRDSD KCAAAVAANMFHYWLDRNR | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE |

TABLE 8-continued

| ID | N-terminus Fc Moiety | Linker | C-terminus Protease Moiety | Full length Sequence |
|---|---|---|---|---|
| | PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | DNVDRFLRQNPEKHGIIEL PDGQLKLSDFLNTYESDDG YRDKSKLFDFISNNFNGPV WTDKLLDNYINGYAYNYKY GRTIEDPTKNTSKINFFKE VFNEKILTNNHSIRNQNEF SVLLSEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 928) | WESNGQPENNYKTTPPVLDSDGSFFLYSKLTV PDGQLKLSDFLNTYESDDG DKSRWQQGNVFSCSVMHEALHNHYTQKSLSLS YRDKSKLFDFISNNFNGPV PGGGGSGGGGSGGGGSGSQTEDSESLQRLRDI WTDKLLDNYINGYAYNYKY EDFQAEKEKQNVVYTKWLDGVDVKDHDFRKIV GRTIEDPTKNTSKINFFKE DGNSAYYATPLLNGRGWYDINKDFNRDSDKCA VFNEKILTNNHSIRNQNEF AAVAANMFHYWLDRNRDNVDRFLRQNPEKHGI SVLLSEALYTGKAIGLSYG IELPDGQLKLSDFLNTYESDDGYRDKSKLFDF PAGLRHSLGHIISVWGADL ISNNFNGPVWTDKLLDNYINGYAYNYKYGRTI DADGNVVAIYVTDSDDKKL EDPTKNTSKINFFKEVFNEKILTNNHSIRNQN TIGDERVGLKRYKISTDDE EFSVLLSEALYTGKAIGLSYGPAGLRHSLGHI GRLRLTAYEETHNTGGQVR ISVWGADLDADGNVVAIYVTDSDDKKLTIGDE GLWTLDTGKQAWADYFDKT RVGLKRYKISTDDEGRLRLTAYEETHNTGGQV EQTGTDQAEQ (SEQ ID RGLWTLDTGKQAWADYFDKTEQTGTDQAEQ NO: 928) (SEQ ID NO: 1198) |
| VRT-177 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGWYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDPTKNTSKINFFKE VFNEKILTNNHSIRNQNEF SVLLIEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 929) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV PDGQLKLSDFLNTYESDDG DKSRWQQGNVFSCSVMHEALHNHYTQKSLSLS YRDKSKLFDFISENFNGPV PGGGGSGGGGSGGGGSGSQTEDSESLQRLRDI WTDKLLDNYINGYAYNYKY EDFQAEKKDQNVVYTKWLDGVDVKDHDFRKIV GRTIEDPTKNTSKINFFKE DGNIAYYATPLLNGRGWYDINKDFNRDSDKCA VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL EDPTKNTSKINFFKEVFNEKILTNNHSIRNQN TIGDERVGLKRYKISTDDE EFSVLLIEALYTGKAIGLSYGPAGLRHSLGHI GRLRLTAYEETHNTGGQVR ISVWGADLDADGNVVAIYVTDSDDKKLTIGDE GLWTLDTGKQAWADYFDKT RVGLKRYKISTDDEGRLRLTAYEETHNTGGQV EQTGTDQAEQ (SEQ ID RGLWTLDTGKQAWADYFDKTEQTGTDQAEQ NO: 929) (SEQ ID NO: 1199) |
| VRT-178 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGLYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDPTKNTSKINFFKE VFNEKILTNNHSIRNQNEL SVLLSEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 930) | DKTHTCPPCPAPEAAGAPSVFLFPPKPKDTLM ISRTPEVTCVVVDVSHEDPEVKFNWYVDGVEV KDHDFRKIVDGNIAYYATP HNAKTKPREEQQNSTYRVVSVLTVLHQDWLNG LLNGRGLYDINKDFNRDSD KEYKCKVSNKALKAPIEKTISKAKGQPREPQV KCAAAVAANMFHYWLDRNR YTLPPSRDELTKNQVSLTCLVKGFYPSDIAVE DNVDRFLRQNPEKHGIIEL WESNGQPENNYKTTPPVLDSDGSFFLYSKLTV PDGQLKLSDFLNTYESDDG DKSRWQQGNVFSCSVMHEALHNHYTQKSLSLS YRDKSKLFDFISENFNGPV PGGGGSGGGGSGGGGSGSQTEDSESLQRLRDI WTDKLLDNYINGYAYNYKY EDFQAEKKDQNVVYTKWLDGVDVKDHDFRKIV GRTIEDPTKNTSKINFFKE DGNIAYYATPLLNGRGLYDINKDFNRDSDKCA VFNEKILTNNHSIRNQNEL AAVAANMFHYWLDRNRDNVDRFLRQNPEKHGI SVLLSEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL EDPTKNTSKINFFKEVFNEKILTNNHSIRNQN TIGDERVGLKRYKISTDDE ELSVLLSEALYTGKAIGLSYGPAGLRHSLGHI GRLRLTAYEETHNTGGQVR ISVWGADLDADGNVVAIYVTDSDDKKLTIGDE GLWTLDTGKQAWADYFDKT RVGLKRYKISTDDEGRLRLTAYEETHNTGGQV EQTGTDQAEQ (SEQ ID RGLWTLDTGKQAWADYFDKTEQTGTDQAEQ NO: 930) (SEQ ID NO: 1200) |
| VRT-179 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNSAYYATP LLNGRGWYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDPTKNTSKINFFKE VFNEKILTNNHSIRNQNEF SVLLIEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 931) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV PDGQLKLSDFLNTYESDDG DKSRWQQGNVFSCSVMHEALHNHYTQKSLSLS YRDKSKLFDFISENFNGPV PGGGGSGGGGSGGGGSGSQTEDSESLQRLRDI WTDKLLDNYINGYAYNYKY EDFQAEKKDQNVVYTKWLDGVDVKDHDFRKIV GRTIEDPTKNTSKINFFKE DGNSAYYATPLLNGRGWYDINKDFNRDSDKCA VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL EDPTKNTSKINFFKEVFNEKILTNNHSIRNQN TIGDERVGLKRYKISTDDE EFSVLLIEALYTGKAIGLSYGPAGLRHSLGHI GRLRLTAYEETHNTGGQVR ISVWGADLDADGNVVAIYVTDSDDKKLTIGDE GLWTLDTGKQAWADYFDKT RVGLKRYKISTDDEGRLRLTAYEETHNTGGQV EQTGTDQAEQ (SEQ ID RGLWTLDTGKQAWADYFDKTEQTGTDQAEQ NO: 931) (SEQ ID NO: 1201) |
| VRT-180 | DKTHTCPPCPAPEA AGAPSVFLFPPKPK | | | DKTHTCPPCPAPEAAGAPSVFLFPPKPKDTLM ISRTPEVTCVVVDVSHEDPEVKFNWYVDGVEV |

TABLE 8-continued

| ID | N-terminus Fc Moiety | Linker | C-terminus Protease Moiety | Full length Sequence |
|---|---|---|---|---|
| | DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | SG (SEQ ID NO: 1020) | KDHDFRKIVDGNSAYYATP LLNGRGFYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDPTKNTSKINFFKE VFNEKILTNNHSIRNQNEF AAVAANMFHYWLDRNRDNVDRFLRQNPEKHGI SVLLIEALYTGKAIGLSYG PAGLRHSLGHIISVWGADL DADGNVVAIYVTDSDDKKL TIGDERVGLKRYKISTDDE GRLRLTAYEETHNTGGQIR GLWTLDTGKQAWADYFDKT EQTGTGTDQAEQ (SEQ ID NO: 932) | HNAKTKPREEQQNSTYRVVSVLTVLHQDWING KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV PDGQLKLSDFLNTYESDDG DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDSDKCA AAVAANMFHYWLDRNRDNVDRFLRQNPEKHGI SVLLIEALYTGKAIGLSYG IELPDGQLKLSDFLNTYESDDGYRDKSKLFDF ISENFNGPVWTDKLLDNYINGYAYNYKYGRTI EDPTKNTSKINFFKEVFNEKILTNNHSIRNQN TIGDERVGLKRYKISTDDE EFSVLLIEALYTGKAIGLSYGPAGLRHSLGHI ISVWGADLDADGNVVAIYVTDSDDKKLTIGDE RGLWTLDTGKQAWADYFDKTEQTGTGTDQAEQ (SEQ ID NO: 1202) |
| VRT-181 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNSKY EDFQAEKKKQNVVYTKWLDGVDVKDHDFRKIV GRTIEDPTKNTSKINFFKE VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHGLGHIISVWGADL ISENFNGPVWTDKLLDNYINGYAYNSKYGRTI DADGNVVAIYVTDSDDKKL EDPTKNTSKINFFKEVFNEKILTNNHSIRNQN TIGDERVGLKRYKISTDDE EFSVLLIEALYTGKAIGLSYGPAGLRHGLGHI GRLRLTAYEETHNTGGQIR ISVWGADLDADGNVVAIYVTDSDDKKLTIGDE GLWTLDTGKQAWADYFDKT RVGLKRYKISTDDEGRLRLTAYEETHNTGGQI EQTGTGTDQAEQ (SEQ ID NO: 933) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDSDKCA AAVAANMFHYWLDRNRDNVDRFLRQNPEKHGI IELPDGQLKLSDFLNTYESDDGYRDKSKLFDF ISENFNGPVWTDKLLDNYINGYAYNSKYGRTI EDPTKNTSKINFFKEVFNEKILTNNHSIRNQN EFSVLLIEALYTGKAIGLSYGPAGLRHGLGHI ISVWGADLDADGNVVAIYVTDSDDKKLTIGDE RVGLKRYKISTDDEGRLRLTAYEETHNTGGQI RGLWTLDTGKQAWADYFDKTEQTGTGTDQAEQ (SEQ ID NO: 1203) |
| VRT-182 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGWYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNSKY GRTIEDPTKNTSKINFFKE VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHGLGHIISVWGADL ISENFNGPVWTDKLLDNYINGYAYNSKYGRTI DADGNVVAIYVTDSDDKKL EDPTKNTSKINFFKEVFNEKILTNNHSIRNQN TIGDERVGLKRYKISTDDE EFSVLLIEALYTGKAIGLSYGPAGLRHGLGHI GRLRLTAYEETHNTGGQVR ISVWGADLDADGNVVAIYVTDSDDKKLTIGDE GLWTLDTGKQAWADYFDKT RVGLKRYKISTDDEGRLRLTAYEETHNTGGQV EQTGTGTDQAEQ (SEQ ID NO: 934) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEKQNVVYTKWLDGVDVKDHDFRKIV DGNSAYYATPLLNGRGWYDINKDFNRDSDKCA AAVAANMFHYWLDRNRDNVDRFLRQNPEKHGI IELPDGQLKLSDFLNTYESDDGYRDKSKLFDF ISENFNGPVWTDKLLDNYINGYAYNSKYGRTI EDPTKNTSKINFFKEVFNEKILTNNHSIRNQN EFSVLLIEALYTGKAIGLSYGPAGLRHGLGHI ISVWGADLDADGNVVAIYVTDSDDKKLTIGDE RVGLKRYKISTDDEGRLRLTAYEETHNTGGQV RGLWTLDTGKQAWADYFDKTEQTGTGTDQAEQ (SEQ ID NO: 1204) |
| VRT-183 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNEAYYATP LLNGRGFYDINKDFNRDSD KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDPTKNTSKINFFKE VFNEKILTNNHSIRNQNEL SVLLSEALYTGKAIGLSYG PAGLRHSLGHIISVWGADL DADGNVVAIYVTDSDDKKL TIGDERVGLKRYKISTDDE GRLRLTAYEETHNTGGQIR GLWTLDTGKQAWADYFDKT EQTGTGTDQAEQ (SEQ ID NO: 935) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNEAYYATPLLNGRGFYDINKDFNRDSDKCA AAVAANMFHYWLDRNRDNVDRFLRQNPEKHGI IELPDGQLKLSDFLNTYESDDGYRDKSKLFDF ISENFNGPVWTDKLLDNYINGYAYNYKYGRTI EDPTKNTSKINFFKEVFNEKILTNNHSIRNQN ELSVLLSEALYTGKAIGLSYGPAGLRHSLGHI ISVWGADLDADGNVVAIYVTDSDDKKLTIGDE RVGLKRYKISTDDEGRLRLTAYEETHNTGGQI RGLWTLDTGKQAWADYFDKTEQTGTGTDQAEQ (SEQ ID NO: 1205) |

TABLE 8-continued

| ID | N-terminus Fc Moiety | Linker | C-terminus Protease Moiety | Full length Sequence |
|---|---|---|---|---|
| VRT-184 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNEAYYATP LLNGRGFYDINKDFNRDSD KCAAAVAANMFHYWLDRNR DNVDRFLRQNPEKHGIIEL PDGQLKLSDFLNTYESDDG YRDKSKLFDFISENENGPV WTDKLLDNYINGYAYNYKY GRLIEDPTKNTSKINFFKE VFNEKILTNNHSIRNQNEL SVLLSEALYTGKAIGLSYG PAGTRHSLGHIISVWGADL ISENFNGPVWTDKLLDNYI DADGNVVAIYVTDSDDKKL TIGDERVGLKRYKISTDDE GRLRLTAYEETHNTGGQIR GLWTLDTGKQAWADYFDKT EQTGTDQAEQ (SEQ ID NO: 936) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNEAYYATPLLNGRGFYDINKDFNRDSDKCA AAVAANMFHYWLDRNRDNVDRFLRQNPEKHGI IELPDGQLKLSDFLNTYESDDGYRDKSKLFDF ISENENGPVWTDKLLDNYINGYAYNYKYGRLI EDPTKNTSKINFFKEVFNEKILTNNHSIRNQN ELSVLLSEALYTGKAIGLSYGPAGTRHSLGHI ISVWGADLDADGNVVAIYVTDSDDKKLTIGDE RVGLKRYKISTDDEGRLRLTAYEETHNTGGQI RGLWTLDTGKQAWADYFDKTEQTGTDQAEQ (SEQ ID NO: 1206) |
| VRT-185 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGFYDINKDFNRDND KCAAAVAANMFHYWLDRNR DNVDRFLRQNPEKHGIIEL PDGQLKLSDFLNTYESDDG YRDKSKLFDFISNNFNGPV WTDKLLDNYINGYAYNYKY GRTIEDSTKNTSKINFFKE VFNEKILTNNHSIRNQNEF AAVAANMFHYWLDRNRDNV SVLLSEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 937) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEKQNVVYTKWLDGVDVKDHDFRKIV DGNSAYYATPLLNGRGFYDINKDFNRDNDKCA AAVAANMFHYWLDRNRDNVDRFLRQNPEKHGI IELPDGQLKLSDFLNTYESDDGYRDKSKLFDF ISNNFNGPVWTDKLLDNYINGYAYNYKYGRTI EDSTKNTSKINFFKEVFNEKILTNNHSIRNQN EFSVLLSEALYTGKAIGLSYGPAGLRHSLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1207) |
| VRT-186 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGWYDINKDFNRDND KCAAAVAANMFHYWLDRNR DNVDRFLRQNPEKHGIIEL PDGQLKLSDFLNTYESDDG YRDKSKLFDFISNNFNGPV WTDKLLDNYINGYAYNYKY GRTIEDSTKNTSKINFFKE VFNEKILTNNHSIRNQNEF SVLLSEALYTGKAIGLSYG PAGLRHSLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 938) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEKQNVVYTKWLDGVDVKDHDFRKIV DGNSAYYATPLLNGRGWYDINKDFNRDNDKCA AAVAANMFHYWLDRNRDNVDRFLRQNPEKHGI IELPDGQLKLSDFLNTYESDDGYRDKSKLFDF ISNNFNGPVWTDKLLDNYINGYAYNYKYGRTI EDSTKNTSKINFFKEVFNEKILTNNHSIRNQN EFSVLLSEALYTGKAIGLSYGPAGLRHSLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1208) |
| VRT-187 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGWYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDSTKNTSKINFFKE VFNEKILTNNHSIRNQNEF SVLLIEALYTGKAIGLSYG PAGLRHSLGHIISVWGADL DADGNVVAIYVTDSDDKKL TIGDERVGLKRYKISTDDE GRLRLTAYEETHNTGGQVR | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNIAYYATPLLNGRGWYDINKDFNRDNDKCA AAVAANMFHYWLDRNRDNVDRFLRQNPEKHGI IELPDGQLKLSDFLNTYESDDGYRDKSKLFDF ISENFNGPVWTDKLLDNYINGYAYNYKYGRTI EDSTKNTSKINFFKEVFNEKILTNNHSIRNQN EFSVLLIEALYTGKAIGLSYGPAGLRHSLGHI ISVWGADLDADGNVVAIYVTDSDDKKLTIGDE |

TABLE 8-continued

| ID | N-terminus Fc Moiety | Linker | C-terminus Protease Moiety | Full length Sequence |
|---|---|---|---|---|
| | PG (SEQ ID NO: 23) | | GLWTLDTGKQAWADYFDKT EQTGTDQAEQ (SEQ ID NO: 939) | RVGLKRYKISTDDEGRLRLTAYEETHNTGGQV RGLWTLDTGKQAWADYFDKTEQTGTDQAEQ (SEQ ID NO: 1209) |
| VRT-188 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNIAYYATP LLNGRGLYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDSTKNTSKINFFKE VFNEKILTNNHSIRNQNEL AVAANMFHYWLDRNRDNVDRFLRQNPEKHGI SVLLSEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL TIGDERVGLKRYKISTDDE GLWTLDTGKQAWADYFDKT EQTGTDQAEQ (SEQ ID NO: 940) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNIAYYATPLLNGRGLYDINKDFNRDNDKCA AAVAANMFHYWLDRNRDNVDRFLRQNPEKHGI IELPDGQLKLSDFLNTYESDDGYRDKSKLFDF ISENFNGPVWTDKLLDNYINGYAYNYKYGRTI EDSTKNTSKINFFKEVFNEKILTNNHSIRNQNEL AAVAANMFHYWLDRNRDNVDRFLRQNPEKHGI SVLLSEALYTGKAIGLSYGPAGLRHSLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1210) |
| VRT-189 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKDQNVVYTKWLDGVDV KDHDFRKIVDGNSAYYATP LLNGRGWYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDSTKNTSKINFFKE VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL EDSTKNTSKINFFKEVFNEKILTNNHSIRNQN TIGDERVGLKRYKISTDDE EFSVLLIEALYTGKAIGLSYGPAGLRHSLGHI GRLRLTAYEETHNTGGQVR ISVWGADLDADGNVVAIYVTDSDDKKLTIGDE GLWTLDTGKQAWADYFDKT EQTGTDQAEQ (SEQ ID NO: 941) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG LLNGRGWYDINKDFNRDNDKEYKCKVSNKALKAPIEKTISKAKGQPREPQV KCAAAVAANMFHYWLDRNRYTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKDQNVVYTKWLDGVDVKDHDFRKIV DGNSAYYATPLLNGRGWYDINKDFNRDNDKCA AAVAANMFHYWLDRNRDNVDRFLRQNPEKHGI IELPDGQLKLSDFLNTYESDDGYRDKSKLFDF ISENFNGPVWTDKLLDNYINGYAYNYKYGRTI EDSTKNTSKINFFKEVFNEKILTNNHSIRNQN TIGDERVGLKRYKISTDDE EFSVLLIEALYTGKAIGLSYGPAGLRHSLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1211) |
| VRT-190 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDSTKNTSKINFFKE VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHSLGHIISVWGADL ISENFNGPVWTDKLLDNYINGYAYNYKYGRTI DADGNVVAIYVTDSDDKKL EDSTKNTSKINFFKEVFNEKILTNNHSIRNQN TIGDERVGLKRYKISTDDE EFSVLLIEALYTGKAIGLSYGPAGLRHSLGHI GRLRLTAYEETHNTGGQIR ISVWGADLDADGNVVAIYVTDSDDKKLTIGDE GLWTLDTGKQAWADYFDKT RVGLKRYKISTDDEGRLRLTAYEETHNTGGQI EQTGTDQAEQ (SEQ ID RGLWTLDTGKQAWADYFDKTEQTGTDQAEQ NO: 942) (SEQ ID NO: 1212) |
| VRT-191 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNSKY GRTIEDSTKNTSKINFFKE VFNEKILTNNHSIRNQNEF AAVAANMFHYWLDRNRDNVDRFLRQNPEKHGI SVLLIEALYTGKAIGLSYG IELPDGQLKLSDFLNTYESDDGYRDKSKLFDF PAGLRHGLGHIISVWGADL ISENFNGPVWTDKLLDNYINGYAYNSKYGRTI | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDNDKCA AAVAANMFHYWLDRNRDNVDRFLRQNPEKHGI IELPDGQLKLSDFLNTYESDDGYRDKSKLFDF ISENFNGPVWTDKLLDNYINGYAYNSKYGRTI |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | DADGNVVAIYVTDSDDKKL TIGDERVGLKRYKISTDDE GRLRLTAYEETHNTGGQIR GLWTLDTGKQAWADYFDKT EQTGTDQAEQ (SEQ ID NO: 943) | EDSTKNTSKINFFKEVFNEKILTNNHSIRNQN EFSVLLIEALYTGKAIGLSYGPAGLRHGLGHI ISVWGADLDADGNVVAIYVTDSDDKKLTIGDE RVGLKRYKISTDDEGRLRLTAYEETHNTGGQI RGLWTLDTGKQAWADYFDKTEQTGTDQAEQ (SEQ ID NO: 1213) |
| VRT-192 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKEKQNVVYTKWLDGVDV KDHDFRKIVDGNSAYYATP LLNGRGWYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNSKY GRTIEDSTKNTSKINFFKE VFNEKILTNNHSIRNQNEF SVLLIEALYTGKAIGLSYG IELPDGQLKLSDFLNTYESDDGYRDKSLFDF PAGLRHGLGHIISVWGADL DADGNVVAIYVTDSDDKKL TIGDERVGLKRYKISTDDE GRLRLTAYEETHNTGGQVR GLWTLDTGKQAWADYFDKT EQTGTDQAEQ (SEQ ID NO: 944) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKEKQNVVYTKWLDGVDVKDHDFRKIV DGNSAYYATPLLNGRGWYDINKDFNRDNDKCA AAVAANMFHYWLDRNRDNVDRFLRQNPEKHGI IELPDGQLKLSDFLNTYESDDGYRDKSLFDF ISENFNGPVWTDKLLDNYINGYAYNSKYGRTI EDSTKNTSKINFFKEVFNEKILTNNHSIRNQN EFSVLLIEALYTGKAIGLSYGPAGLRHGLGHI ISVWGADLDADGNVVAIYVTDSDDKKLTIGDE RVGLKRYKISTDDEGRLRLTAYEETHNTGGQV RGLWTLDTGKQAWADYFDKTEQTGTDQAEQ (SEQ ID NO: 1214) |
| VRT-193 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNEAYYATP LLNGRGFYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRTIEDSTKNTSKINFFKE VFNEKILTNNHSIRNQNEL AAVAANMFHYWLDRNRDNVDRFLRQNPEKHGI SVLLSEALYTGKAIGLSYG IELPDGQLKLSDFLNTYESDDGYRDKSLFDF PAGLRHSLGHIISVWGADL ISENFNGPVWTDKLLDNYINGYAYNYKYGRTI DADGNVVAIYVTDSDDKKL EDSTKNTSKINFFKEVFNEKILTNNHSIRNQN TIGDERVGLKRYKISTDDE ELSVLLSEALYTGKAIGLSYGPAGLRHSLGHI GRLRLTAYEETHNTGGQIR ISVWGADLDADGNVVAIYVTDSDDKKLTIGDE GLWTLDTGKQAWADYFDKT RVGLKRYKISTDDEGRLRLTAYEETHNTGGQI EQTGTDQAEQ (SEQ ID NO: 945) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNEAYYATPLLNGRGFYDINKDFNRDNDKCA AAVAANMFHYWLDRNRDNVDRFLRQNPEKHGI IELPDGQLKLSDFLNTYESDDGYRDKSLFDF ISENFNGPVWTDKLLDNYINGYAYNYKYGRTI EDSTKNTSKINFFKEVFNEKILTNNHSIRNQN ELSVLLSEALYTGKAIGLSYGPAGLRHSLGHI ISVWGADLDADGNVVAIYVTDSDDKKLTIGDE RVGLKRYKISTDDEGRLRLTAYEETHNTGGQI RGLWTLDTGKQAWADYFDKTEQTGTDQAEQ (SEQ ID NO: 1215) |
| VRT-194 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNEAYYATP LLNGRGFYDINKDFNRDND KCAAAVAANMFHYWLDRNR DNVDRFLRQNPEKHGIIEL PDGQLKLSDFLNTYESDDG YRDKSKLFDFISENFNGPV WTDKLLDNYINGYAYNYKY GRLIEDSTKNTSKINFFKE VFNEKILTNNHSIRNQNEL SVLLSEALYTGKAIGLSYG PAGTRHSLGHIISVWGADL DADGNVVAIYVTDSDDKKL TIGDERVGLKRYKISTDDE GRLRLTAYEETHNTGGQIR GLWTLDTGKQAWADYFDKT EQTGTDQAEQ (SEQ ID NO: 946) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNEAYYATPLLNGRGFYDINKDFNRDNDKCA AAVAANMFHYWLDRNRDNVDRFLRQNPEKHGI IELPDGQLKLSDFLNTYESDDGYRDKSLFDF ISENFNGPVWTDKLLDNYINGYAYNYKYGRTI EDSTKNTSKINFFKEVFNEKILTNNHSIRNQN ELSVLLSEALYTGKAIGLSYGPAGTRHSLGHI ISVWGADLDADGNVVAIYVTDSDDKKLTIGDE RVGLKRYKISTDDEGRLRLTAYEETHNTGGQI RGLWTLDTGKQAWADYFDKTEQTGTDQAEQ (SEQ ID NO: 1216) |
| VRT-195 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK | GGGGSGG GGSGGGG SG (SEQ ID NO: 1020) | VTSVWTKGVTPPAKFTQGE DVFHAPYVANQGWYDITKT FNGKDNLLCGAATAGNMLH WWFDQNKEKIEAYLKKHPD KQKIIFGDQELLDVRKVIN TKGDTNSELFNYFRDKAF PGLSARRIGVFPDLVLDMF INGYYLNVYKTQTTDVNRT YQEKDRRGGIFDAVFTRGV TQGEDVFHAPYVANQGWYDITKTFNGKDNLLC QSKLLTSRHDFKEKNLKEI GAATAGNMLHWWFDQNKEKIEAYLKKHPDKQK | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF |

TABLE 8-continued

| ID | N-terminus Fc Moiety | Linker | C-terminus Protease Moiety | Full length Sequence |
|---|---|---|---|---|
| | NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | SDLIKKELTEGKALGLSHT YANVRINHVINLWGADFDS NGNLKAIYVTDSDTNASIG MKKYFVGVNSAGKVAISAK EIKEDNIGAQVLGLFTLST GQDSWNQTN (SEQ ID NO: 947) | IIFGDQELLDVRKVINTKGDQTNSELFNYFRD KAFPGLSARRIGVFPDLVLDMFINGYYLNVYK TQTTDVNRTYQEKDRRGGIFDAVFTRGVQSKL LTSRHDFKEKNLKEISDLIKKELTEGKALGLS HTYANVRINHVINLWGADFDSNGNLKAIYVTD SDTNASIGMKKYFVGVNSAGKVAISAKEIKED NIGAQVLGLFTLSTGQDSWNQTN (SEQ ID NO: 1217) |
| VRT-196 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR YNNEDVIHAPYLAHQGWYD ITKAFDGKDNLLCGAATAG NMLHWWFDQNKTEIEAYLS KHPEKQKIIFNNQELFDLK AAIDTKDSQTNSQLFNYFR DKAFPGLSARQLGVFPDLV LDMFINGYYLNVFKTQSTD VNRPYQDKDKGRGGIFDAVF TRGVQTTLLLTARHDLKNKG NLLCGAATAGNMLHWWFDQNKTEIEAYLSKHP LNDISTIIKQELTEGRALA LSHTYANVRISHVINLWGA DFNAEGNLEAIYVTDSDAN ASIGMKKYFVGINAHGHVA ISAKKIEGENIGAQVLGLF TLSSGKDIWQKLS (SEQ ID NO: 948) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRYNNEDVIHAPYLAHQGWYDITKAFDGKD NLLCGAATAGNMLHWWFDQNKTEIEAYLSKHP EKQKIIFNNQELFDLKAAIDTKDSQTNSQLFN YFRDKAFPGLSARQLGVFPDLVLDMFINGYYL NVFKTQSTDVNRPYQDKDKRGGIFDAVFTRGV QTTLLLTARHDLKNKGLNDISTIIKQELTEGRA LASHTYANVRISHVINLWGADFNAEGNLEAI YVTDSDANASIGMKKYFVGINAHGHVAISAKK IEGENIGAQVLGLFTLSSGKDIWQKLS (SEQ ID NO: 1218) |
| VRT-197 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNIAYYATP LLNGRGFYDINKDFNRDND KCAAAVAANMFHYWLDINR DNVDRFLRQNPEKHGIIEL PDGQLKLSDFLNTYESDHG YRDKSKLFDFISNNFNGPV WTDKLLDNYINGYAYNYKY GRTIEDSTKNTSKINFFKE VFNEKILTNNHSIRNQNEF SVLLSEALYTGKAIGLSYG IELPDGQLKLSDFLNTYESDHGYRDKSKLFDF PAGLRHSLGHIISVWGADL DADGNVVAIYVTDSDDKKL TIGDERVGLKRYKISTDDE NRLRLTAYEETHNTGGQIR EQTGTDQAEQ (SEQ ID NO: 949) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNIAYYATPLLNGRGFYDINKDFNRDNDKCA AAVAANMFHYWLDINRDNVDRFLRQNPEKHGI IELPDGQLKLSDFLNTYESDHGYRDKSKLFDF ISNNFNGPVWTDKLLDNYINGYAYNYKYGRTI EDSTKNTSKINFFKEVFNEKILTNNHSIRNQN EFSVLLSEALYTGKAIGLSYGIELPDGQLKLSDFLNTYESDHGYRDKSKLFDF ISVWGADLDADGNVVAIYVTDSDDKKLTIGDE RVGLKRYKISTDDENRLRLTAYEETHNTGGQI RGLWTLDTGKYAWADYFDKTEQTGTDQAEQ (SEQ ID NO: 1219) |
| VRT-198 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAQFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PYLSTKHLGVFPDHVIDMF INGYRLSLTNHGPTPVKEG SKDPRGGIFDAVFTRGDQS KLLTSRHDFKEKNLKEISD LIKKELTEGKALGLSHTYA NVRINHVINLWGADFDSNG NLKAIYVTDSDSNASIGMK KYFVGVNSAGKVAISAKEI KEDNIGAQVLGLFTLSTGQ DSWNQTN (SEQ ID NO: 950) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAQF TQGEDVFHAPYVANQGWYDITKTFNGKDDLLC GAATAGNMLHWWFDQNKDQIKRYLEEHPEKQK INFNGEQMFDVKEAIDTKNHQLDSKLFEYFKE NVRINHVINLWGADFDSNG KAFPYLSTKHLGVFPDHVIDMFINGYRLSLTN HGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNASIGMKKYFVGVNSAGKVAISAKEIKEDNI GAQVLGLFTLSTGQDSWNQIN (SEQ ID NO: 1220) |
| VRT-199 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK | GGGGSGG GGSGGGG SGGGGSG (SEQ ID NO: 1021) | VTSVWTKGVTPPAQFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PYLSTKHLGVFPDHVIDMF INGYRLSLTNHGPTPVKEG SKDPRGGIFDAVFTRGDQS KLLTSRHDFKEKNLKEISD | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGGGGSGVTSVWTKGVT PPAQFTQGEDVFHAPYVANQGWYDITKTFNGK DDLLCGAATAGNMLHWWFDQNKDQIKRYLEEH |

TABLE 8-continued

| ID | N-terminus Fc Moiety | Linker | C-terminus Protease Moiety | Full length Sequence |
|---|---|---|---|---|
| | NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | LIKKELTEGKALGLSHTYA NVRINHVINLWGADFDSNG NLKAIYVTDSDSNASIGMK KYFVGVNSAGKVAISAKEI KEDNIGAQVLGLFTLSTGQ DSWNQTN (SEQ ID NO: 951) | PEKQKINFNGEQMFDVKEAIDTKNHQLDSKLF EYFKEKAFPYLSTKHLGVFPDHVIDMFINGYR LSLTNHGPTPVKEGSKDPRGGIFDAVFTRGDQ SKLLTSRHDFKEKNLKEISDLIKKELTEGKAL GLSHTYANVRINHVINLWGADFDSNGNLKAIY VTDSDSNASIGMKKYFVGVNSAGKVAISAKEI KEDNIGAQVLGLFTLSTGQDSWNQTN (SEQ ID NO: 1221) |
| VRT-200 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSG (SEQ ID NO: 1022) | VTSVWTKGVTPPAQFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PYLSTKHLGVFPDHVIDMF INGYRLSLTNHGPTPVKEG SKDPRGGIFDAVFTRGDQS KLLTSRHDFKEKNLKEISD LIKKELTEGKALGLSHTYA NVRINHVINLWGADFDSNG NLKAIYVTDSDSNASIGMK KYFVGVNSAGKVAISAKEI KEDNIGAQVLGLFTLSTGQ DSWNQTN (SEQ ID NO: 952) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGVTSVWTKGVTPPAQFTQGED VFHAPYVANQGWYDITKTFNGKDDLLCGAATA GNMLHWWFDQNKDQIKRYLEEHPEKQKINFNG EQMFDVKEAIDTKNHQLDSKLFEYFKEKAFPY LSTKHLGVFPDHVIDMFINGYRLSLTNHGPTP VKEGSKDPRGGIFDAVFTRGDQSKLLTSRHDF KEKNLKEISDLIKKELTEGKALGLSHTYANVR INHVINLWGADFDSNGNLKAIYVTDSDSNASI GMKKYFVGVNSAGKVAISAKEIKEDNIGAQVL GLFTLSTGQDSWNQTN (SEQ ID NO: 1222) |
| VRT-201 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | ANQEIRYSEVTPYHVTSVW TKGVTPPAQFTQGEDVFHA PYVANQGWYDITKTFNGKD DLLCGAATAGNMLHWWFDQ NKDQIKRYLEEHPEKQKIN FNGEQMFDVKEAIDTKNHQ LDSKLFEYFKEKAFPYLST KHLGVFPDHVIDMFINGYR LSLTNHGPTPVKEGSKDPR GGIFDAVFTRGDQSKLLTS RHDFKEKNLKEISDLIKKE LTEGKALGLSHTYANVRIN HVINLWGADFDSNGNLKAI YVTDSDSNASIGMKKYFVG VNSAGKVAISAKEIKEDNI GAQVLGLFTLSTGQDSWNQ TN (SEQ ID NO: 953) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGANQEIRYSEVTPYHV TSVWTKGVTPPAQFTQGEDVFHAPYVANQGWY DITKTFNGKDDLLCGAATAGNMLHWWFDQNKD QIKRYLEEHPEKQKINFNGEQMFDVKEAIDTK NHQLDSKLFEYFKEKAFPYLSTKHLGVFPDHV IDMFINGYRLSLTNHGPTPVKEGSKDPRGGIF DAVFTRGDQSKLLTSRHDFKEKNLKEISDLIK KELTEGKALGLSHTYANVRINHVINLWGADFD SNGNLKAIYVTDSDSNASIGMKKYFVGVNSAG KVAISAKEIKEDNIGAQVLGLFTLSTGQDSWN QTN (SEQ ID NO: 1223) |
| VRT-202 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAQFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PYLSTKHLGVFPDHVIDMF INGYRLSLTNHGPTPVKEG SKDPRGGIFDAVFTRGDQS KLLTSRHDFKEKNLKEISD LIKKELTEGKALGLSHTYA NVRINHVINLWGADFDSNG NLKAIYVTDSDSNASIGMK KYFVGVNSAGKVAISAKEI KEDNIGAQVLGLFTLSTGQ DSWNQIN (SEQ ID NO: 954) | DKTHTAPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAQF TQGEDVFHAPYVANQGWYDITKTFNGKDDLLC GAATAGNMLHWWFDQNKDQIKRYLEEHPEKQK INFNGEQMFDVKEAIDTKNHQLDSKLFEYFKE KAFPYLSTKHLGVFPDHVIDMFINGYRLSLTN HGPTPVKEGSKDPRGGIFDAVFTRGDQSKLLT SRHDFKEKNLKEISDLIKKELTEGKALGLSHT YANVRINHVINLWGADFDSNGNLKAIYVTDSD SNASIGMKKYFVGVNSAGKVAISAKEIKEDNI GAQVLGLFTLSTGQDSWNQTN (SEQ ID NO: 1224) |
| VRT-203 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SGGGGS (SEQ ID NO: 1021) | SQTEDSESLQRLRDIEDFQ AEKKMQNVVYTKWLDGVDV KDHDFRKIVDGNIAYYATP LLNGRGFYDINKDFNRDND KCAAAVAANMFHYWLDINR DNVDRFLRQNPEKHGIIEL PDGQLKLSDFLNTYESDHG YRDSKLFDFISNNFNGPV WTDKLLDNYINGYAYNYKY GRTIEDSTKNTSKINFFKE VFNEKILTNNHSIRNQNEF | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGGGGSGSQTEDSESLQ RLRDIEDFQAEKKMQNVVYTKWLDGVDVKDHD FRKIVDGNIAYYATPLLNGRGFYDINKDFNRD NDKCAAAVAANMFHYWLDINRDNVDRFLRQNP |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | SVLLSEALYTGKAIGLSYG PAGLRHSLGHIISVWGADL DADGNVVAIYVTDSDDKKL TIGDERVGLKRYKISTDDE NRLRLTAYEETHNTGGQIR GLWILDTGKYAWADYFDKT EQTGTDQAEQ (SEQ ID NO: 955) | EKHGIIELPDGQLKLSDFLNTYESDHGYRDKS KLFDFISNNFNGPVWTDKLLDNYINGYAYNYK YGRTIEDSTKNTSKINFFKEVFNEKILTNNHS IRNQNEFSVLLSEALYTGKAIGLSYGPAGLRH SLGHIISVWGADLDADGNVVAIYVTDSDDKKL TIGDERVGLKRYKISTDDENRLRLTAYEETHN TGGQIRGLWTLDTGKYAWADYFDKTEQTGTDQ AEQ (SEQ ID NO: 1225) |
| VRT-204 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSG (SEQ ID NO: 1022) | SQTEDSESLQRLRDIEDFQ AEKKMQNVVYTKWLDGVDV KDHDFRKIVDGNIAYYATP LLNGRGFYDINKDFNRDND KCAAAVAANMFHYWLDINR DNVDRFLRQNPEKHGIIEL PDGQLKLSDFLNTYESDHG YRDKSKLFDFISNNFNGPV WTDKLLDNYINGYAYNYKY GRTIEDSTKNTSKINFFKE VFNEKILTNNHSIRNQNEF SVLLSEALYTGKAIGLSYG PAGLRHSLGHIISVWGADL DADGNVVAIYVTDSDDKKL TIGDERVGLKRYKISTDDE NRLRLTAYEETHNTGGQIR GLWILDTGKYAWADYFDKT EQTGTDQAEQ (SEQ ID NO: 956) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGSQTEDSESLQRLRDIEDFQA EKKMQNVVYTKWLDGVDVKDHDFRKIVDGNIA YYATPLLNGRGFYDINKDFNRDNDKCAAAVAA NMFHYWLDINRDNVDRFLRQNPEKHGIIELPD GQLKLSDFLNTYESDHGYRDKSKLFDFISNNF NGPVWTDKLLDNYINGYAYNYKYGRTIEDSTK NTSKINFFKEVFNEKILTNNHSIRNQNEFSVL LSEALYTGKAIGLSYGPAGLRHSLGHIISVWG ADLDADGNVVAIYVTDSDDKKLTIGDERVGLK RYKISTDDENRLRLTAYEETHNTGGQIRGLWT LDTGKYAWADYFDKTEQTGTDQAEQ (SEQ ID NO: 1226) |
| VRT-205 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SGGGGSG (SEQ ID NO: 1021) | RDIEDFQAEKKMQNVVYTK WLDGVDVKDHDFRKIVDGN IAYYATPLLNGRGFYDINK DFNRDNDKCAAAVAANMFH YWLDINRDNVDRFLRQNPE KHGIIELPDGQLKLSDFLN TYESDHGYRDKSKLFDFIS NNFNGPVWTDKLLDNYING YAYNYKYGRTIEDSTKNTS KINFFKEVFNEKILTNNHS IRNQNEFSVLLSEALYTGK AIGLSYGPAGLRHSLGHII SVWGADLDADGNVVAIYVT DSDDKKLTIGDERVGLKRY KISTDDENRLRLTAYEETH NTGGQIRGLWTLDTGKYAW ADYFDKTEQTGTDQAEQ (SEQ ID NO: 957) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGGGGSGRDIEDFQAEK KMQNVVYTKWLDGVDVKDHDFRKIVDGNIAYY ATPLLNGRGFYDINKDFNRDNDKCAAAVAANM FHYWLDINRDNVDRFLRQNPEKHGIIELPDGQ AIGLSYGPAGLRHSLGHIILKLSDFLNTYESDHGYRDKSKLFDFISNNFNG SVWGADLDADGNVVAIYVTPVWTDKLLDNYINGYAYNYKYGRTIEDSTKNT DSDDKKLTIGDERVGLKRYSKINFFKEVFNEKILTNNHSIRNQNEFSVLLS KISTDDENRLRLTAYEETHEALYTGKAIGLSYGPAGLRHSLGHIISVWGAD NTGGQIRGLWTLDTGKYAWLDADGNVVAIYVTDSDDKKLTIGDERVGLKRY ADYFDKTEQTGTDQAEQ KISTDDENRLRLTAYEETHNTGGQIRGLWTLD TGKYAWADYFDKTEQTGTDQAEQ (SEQ ID NO: 1227) |
| VRT-206 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAQFTQGE DVFHAPYVANQGWYDITKT FNGKDDLLCGAATAGNMLH WWFDQNKDQIKRYLEEHPE KQKINFNGEQMFDVKEAID TKNHQLDSKLFEYFKEKAF PYLSTKHLGVFPDHVIDMF INGYRLSLTNHGPTPVKQG SKDPRGGIFDAVFTRGDQS KLLTSRHDPKEKNLKQISD LIKKELTEGKALGLSHTYA INFNGEQMFDVKEAIDTKN HQLDSKLFEYFKE NVRINHVINLWGADFDSNG NLKAIYVTDSDSNASIGMK KYFVGVNSAGKVAISAKEI KQDNIGAQVLGLFTLSTGQ QSWNQTN (SEQ ID NO: 958) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSVTSVWTKGVTPPAQF TQGEDVFHAPYVANQGWYDITKTFNGKDDLLC GAATAGNMLHWWFDQNKDQIKRYLEEHPEKQK INFNGEQMFDVKEAIDTKNHQLDSKLFEYFKE KAFPYLSTKHLGVFPDHVIDMFINGYRLSLIN NLKAIYVTDSDSNASIGMKHGPTPVKQGSKDPRGGIFDAVFTRGDQSKLLT SRHDFKEKNLKQISDLIKKELTEGKALGLSHT YANVRINHVINLWGADFDSNGNLKAIYVTDSD SNASIGMKKYFVGVNSAGKVAISAKEIKQDNI GAQVLGLFTLSTGQQSWNQTN (SEQ ID NO: 1228) |
| VRT-207 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP | GGGGSGG GGSGGGG SG (SEQ ID NO: 1020) | VTSVWTKGVTPPANFTQGE DVFHAPYVANQGWYDITKT FNGKDTLLCGAATAGNMLH WWFDQNKDQIKRYLEEHPE KQKINFKGEQLFDVKEAID TKNHQLDSKLFEYPKEKAF PSLSTKHLGVFPDHVIDMF INGYRLSLLNHGPTPVKEG SKDKRGGIFDAVFTRGVQS | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDTLLC |

TABLE 8-continued

| ID | N-terminus Fc Moiety | Linker | C-terminus Protease Moiety | Full length Sequence |
|---|---|---|---|---|
| | QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | KLLTSRHDFKEKNLKEISD LIKKELTEGKALGLSHTYA NVRINHVINLWGADFDSNG NLKAIYVTDSDTEASIGMK KYVVGVNKAGKVAISAKEI SRHDFKEKNLKEISDLIKKELTEGKALGLSHT YANVRINHVINLWGADFDSNGNLKAIYVTDSD TEASIGMKKYVVGVNKAGKVAISAKEIKEDNI GAQVLGLFTLSTGQDSWNQTN (SEQ ID NO: 959) | GAATAGNMLHWWFDQNKDQIKRYLEEHPEKQK LIKKELTEGKALGLSHTYA INFKGEQLFDVKEAIDTKNHQLDSKLFEYFKE KAFPSLSTKHLGVFPDHVIDMFINGYRLSLLN HGPTPVKEGSKDKRGGIFDAVFTRGVQSKLLT SRHDFKEKNLKEISDLIKKELTEGKALGLSHT YANVRINHVINLWGADFDSNGNLKAIYVTDSD TEASIGMKKYVVGVNKAGKVAISAKEIKEDNI GAQVLGLFTLSTGQDSWNQTN (SEQ ID NO: 1229) |
| VRT-208 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKT FNGKDTLLCGAATAGNMLH WWFDQNKDQIKRYLEEHPE KQKINFKGEQLFDVKEAID TKNHQLDSKLFEYFKEKAF PSLSTKHLGVFPDHVIDMF INGYRLSLLNHGPTPVKEG SKDKRGGIFDAVFTRGVQS KLLTSRHDFKEKNLKEISD LIKKELTEGKALGLSHTYA INFKGEQLFDVKEAIDTKNHQLDSKLFEYFKE NARINHVINLWGADFDSNG NLKAIYVTDSDTEPSIGMK KYVVGVNKAGKVAISAKEI KEDNIGAQVLGLFTLSTGQ DSWNQTN (SEQ ID NO: 960) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDTLLC GAATAGNMLHWWFDQNKDQIKRYLEEHPEKQK LIKKELTEGKALGLSHTYA INFKGEQLFDVKEAIDTKNHQLDSKLFEYFKE NARINHVINLWGADFDSNGNLKAIYVTDSD TEPSIGMKKYVVGVNKAGKVAISAKEIKEDNI GAQVLGLFTLSTGQDSWNQTN (SEQ ID NO: 1230) |
| VRT-209 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKL FNGKDTLLCGAATAGNMLH WWFDQNKDQIKRYLEEHPE KQKINFKGEQLFDVKEAID TKNHQLDSKLFEYFLEKAF PSLSTKHLGVFPDHVIDMF INGYRLSLLNHGPTPVKEG SKDKRGGIFDAVFTRGVQS KLLTSRHDFKEKNLKEISD LIKKELTEGKALGLSHTYA INFKGEQLFDVKEAIDTKNHQLDSKLFEYFLE NARINHVINLWGADFDSNG NLKAIYVTDSDTEPSIGMK KYVVGVNKAGKVAISAKEI KEDNIGAQVLGLFTLSTGQ DSWNQTN (SEQ ID NO: 961) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDTLLC GAATAGNMLHWWFDQNKDQIKRYLEEHPEKQK LIKKELTEGKALGLSHTYA INFKGEQLFDVKEAIDTKNHQLDSKLFEYFLE NARINHVINLWGADFDSNGNLKAIYVTDSD TEPSIGMKKYVVGVNKAGKVAISAKEIKEDNI GAQVLGLFTLSTGQDSWNQTN (SEQ ID NO: 1231) |
| VRT-210 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKT FNGKDTLLCGAATAGNMLH WWFDQNKDQIKRYLEEHPE KQKINFNGEQLFDVKEAID TKNHQLDSKLFEYFKEKAF PSLSTKHLGVFPDHVIDMF INGYRLSLLNHGPTPVKEG SKDKRGGIFDAVFTRGVQS KLLTSRHDFKEKNLKEISD LIKKELTEGKALGLSHTYA INFKGEQLFDVKEAIDTKNHQLDSKLFEYFKE NVRINHVINLWGADFDSNG NLKAIYVTDSDTEASIGMK KYVVGVNSAGKVAISAKEI KEDNIGAQVLGLFTLSTGQ DSWNQTN (SEQ ID NO: 962) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDTLLC GAATAGNMLHWWFDQNKDQIKRYLEEHPEKQK LIKKELTEGKALGLSHTYA INFKGEQLFDVKEAIDTKNHQLDSKLFEYFKE NVRINHVINLWGADFDSNGNLKAIYVTDSD TEASIGMKKYVVGVNSAGKVAISAKEIKEDNI GAQVLGLFTLSTGQDSWNQTN (SEQ ID NO: 1232) |
| VRT-211 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK | GGGGSGG GGSGGGG SG (SEQ ID NO: 1020) | VTSVWTKGVTPPANFTQGE DVFHAPYVANQGWYDITKT FNGKDTLLCGAATAGNMLH WWFDQNKDQIKRYLEEHPE KQKINFKGEQLFDVKEAID TKNHQLDSKLFEYFKEKAF PSLSTKHLGVFPDHVIDMF INGYRLSLLNHGPTPVKEG SKDKRGGIFDAVFTRGVQS KLLTSRHDFKEKNLKEISD | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKTFNGKDTLLC GAATAGNMLHWWFDQNKDQIKRYLEEHPEKQK |

TABLE 8-continued

| ID | N-terminus Fc Moiety | Linker | C-terminus Protease Moiety | Full length Sequence |
|---|---|---|---|---|
| | NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | | LIKKELTEGKALGLSHTYA NARINHVINLWGADFDSNG NLKAIYVTDSDTEPSIGMK KYVVGVNSAGKVAISAKEI SRHDFKEKNLKEISDLIKKELTEGKALGLSHT KEDNIGAQVLGLFTLSTGQ DSWNQTN (SEQ ID NO: 963) | INFNGEQLFDVKEAIDTKNHQLDSKLFEYFKE KAFPSLSTKHLGVFPDHVIDMFINGYRLSLLN HGPTPVKEGSKDKRGGIFDAVFTRGVQSKLLT YANARINHVINLWGADFDSNGNLKAIYVTDSD TEPSIGMKKYVVGVNSAGKVAISAKEIKEDNI GAQVLGLFTLSTGQDSWNQIN (SEQ ID NO: 1233) |
| VRT-212 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPANFTQGE DVFHAPYVANQGWYDITKL FNGKDTLLCGAATAGNMLH WWFDQNKDQIKRYLEEHPE KQKINFNGEQLFDVKEAID TKNHQLDSKLFEYFLEKAF PSLSTKHLGVFPDHVIDMF INGYRLSLLNHGPTPVKEG SKDKRGGIFDAVFTRGVQS KLLTSRHDFKEKNLKEISD LIKKELTEGKALGLSHTYA NARINHVINLWGADFDSNG NLKAIYVTDSDTEPSIGMK KYVVGVNSAGKVAISAKEI KEDNIGAQVLGLFTLSTGQ DSWNQTN (SEQ ID NO: 964) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPANF TQGEDVFHAPYVANQGWYDITKLFNGKDTLLC GAATAGNMLHWWFDQNKDQIKRYLEEHPEKQK INFNGEQLFDVKEAIDTKNHQLDSKLFEYFLE KAFPSLSTKHLGVFPDHVIDMFINGYRLSLLN HGPTPVKEGSKDKRGGIFDAVFTRGVQSKLLT SRHDFKEKNLKEISDLIKKELTEGKALGLSHT YANARINHVINLWGADFDSNGNLKAIYVTDSD TEPSIGMKKYVVGVNSAGKVAISAKEIKEDNI GAQVLGLFTLSTGQDSWNQTN (SEQ ID NO: 1234) |
| VRT-213 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYKANQGWYDITKT FNGKDNLLCGAATAGNMLH WWFDQNKEKIEAYLKKHPD KQKIIFGDQELLDVRKVIN TKGDQTNSELFNYFRDKAF PGLSARRIGVFPDLVLDMF INGYYLNVYKTQTTDVNRT YQEKDRRGGIFDAVFTRGV QSKLLTSRHDFKEKNLKEI GAATAGNMLHWWFDQNKEKIEAYLKKHPDKQK SDLIKKELTEGKALGLSHT IIFGDQELLDVRKVINTKGDQTNSELFNYFRD YANVGINHVINLWGADFDS KAFPGLSARRIGVFPDLVLDMFINGYYLNVYK NGNLKAIYVTDSDTNASIG TQTTDVNRTYQEKDRRGGIFDAVFTRGVQSKL MKKYVVGVNSAGKVAISAK LTSRHDFKEKNLKEISDLIKKELTEGKALGLS EIKEDNIGAQVLGLFTLST HTYANVGINHVINLWGADFDSNGNLKAIYVTD GQDSWNQTN (SEQ ID NO: 965) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYKANQGWYDITKTFNGKDNLLC GAATAGNMLHWWFDQNKEKIEAYLKKHPDKQK IIFGDQELLDVRKVINTKGDQTNSELFNYFRD KAFPGLSARRIGVFPDLVLDMFINGYYLNVYK TQTTDVNRTYQEKDRRGGIFDAVFTRGVQSKL LTSRHDFKEKNLKEISDLIKKELTEGKALGLS HTYANVGINHVINLWGADFDSNGNLKAIYVTD SDTNASIGMKKYVVGVNSAGKVAISAKEIKED NIGAQVLGLFTLSTGQDSWNQTN (SEQ ID NO: 1235) |
| VRT-214 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYKANQGWYDITKT FNGKDNLLCGAATAGNMLH WWFDQNKEKIEAYLKKHPD KQKIIFGDQELLDVRKVIN TKGDQTNSELFNYFRDKAF PTLSARRIGVFPDLVLDMF INGYYLNVYKTQTTDVNRT YQEKDRRGGIFDAVFTRGV QSKLLTSRHDFKEKNLKEI SDLIKKELTEGKALGLSHT TANVGINHVINLWGADFDS NGNLKAIYVTDSDTNASIG MKKYVVGVNSAGKVAISAK EIKEDNIGAQVLGLFTLST GQDSWNQTN (SEQ ID NO: 966) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYKANQGWYDITKTFNGKDNLLC GAATAGNMLHWWFDQNKEKIEAYLKKHPDKQK IIFGDQELLDVRKVINTKGDQTNSELFNYFRD KAFPTLSARRIGVFPDLVLDMFINGYYLNVYK TQTTDVNRTYQEKDRRGGIFDAVFTRGVQSKL LTSRHDFKEKNLKEISDLIKKELTEGKALGLS HTTANVGINHVINLWGADFDSNGNLKAIYVTD SDTNASIGMKKYVVGVNSAGKVAISAKEIKED NIGAQVLGLFTLSTGQDSWNQTN (SEQ ID NO: 1236) |
| VRT-215 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | VTSVWTKGVTPPAKFTQGE DVFHAPYKANQGWYDITKT FNRKDNLLCGAATAGNMLH WWFDQNKEKIEAYLKKHPD KQKIIFGDQELLDVRKVIN TKGDQTNSELFNYFRDKAF PGLSARRIGVFPDLVLDMF INGYYLNVYKTQTTDVNRT YQEKDRRGGIFDAVFTRGV QSKLLTSRHDFKEKNLKEI SDLIKKELTEGKALGLSHT | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYKANQGWYDITKTFNRKDNLLC GAATAGNMLHWWFDQNKEKIEAYLKKHPDKQK IIFGDQELLDVRKVINTKGDQTNSELFNYFRD |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | YANVGINHVINLWGADFDS NGNLKAIYVTDSDTRASIG MKKYVVGVNAAGKVAISAK EIKEDNIGAQVLGLFTLST GQDSWNQTN (SEQ ID NO: 967) | KAFPGLSARRIGVFPDLVLDMFINGYYLNVYK TQTTDVNRTYQEKDRRGGIFDAVFTRGVQSKL LTSRHDFKEKNLKEISDLIKKELTEGKALGLS HTYANVGINHVINLWGADFDSNGNLKAIYVTD SDTRASIGMKKYVVGVNAAGKVAISAKEIKED NIGAQVLGLFTLSTGQDSWNQTN (SEQ ID NO: 1237) |
| VRT-216 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPAKFTQGE DVFHAPYKANQGWYDITKT FNRKDNLLCGAATAGNMLH WWFDQNKEKIEAYLKKHPD KQKIIFGDQELLDVRKVIN TKGDQTNSELFNYFRDKAF PTLSARRIGVFPDLVLDMF INGYYLNVYKTQTTDVNRT YQEKDRRGGIFDAVFTRGV QSKLLTSRHDFKEKNLKEI SDLIKKELTEGKALGLSHT TANVGINHVINLWGADFDS NGNLKAIYVTDSDTRASIG MKKYVVGVNAAGKVAISAK EIKEDNIGAQVLGLFTLST GQDSWNQTN (SEQ ID NO: 968) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPAKF TQGEDVFHAPYKANQGWYDITKTFNRKDNLLC GAATAGNMLHWWFDQNKEKIEAYLKKHPDKQK IIFGDQELLDVRKVINTKGDQTNSELFNYFRD KAFPTLSARRIGVFPDLVLDMFINGYYLNVYK TQTTDVNRTYQEKDRRGGIFDAVFTRGVQSKL LTSRHDFKEKNLKEISDLIKKELTEGKALGLS HTTANVGINHVINLWGADFDSNGNLKAIYVTD SDTRASIGMKKYVVGVNAAGKVAISAKEIKED NIGAQVLGLFTLSTGQDSWNQTN (SEQ ID NO: 1238) |
| VRT-217 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFR DKAFPGLSARQLGVMPDLV LDMFINGYYLNVPKTQSTD VNRPYQDKDKRGGIFDAVF TRGVQTTLLLTARHDLKNKG NLLDISTIIKQELTEGRALA LSHTYANVRISHVINLWGA DFNAEGNLEAIYVTDSDAN ASIGMKKYAVGINAHGHVA ISAKKIEGENIGAQVLGLF TLSSGKDIWQKLS (SEQ ID NO: 969) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN LSHTYANVRISHVINLWGAYFLDKAFPGLSARQLGVMPDLVLDMFINGYYL DFNAEGNLEAIYVTDSDANVPKTQSTDVNRPYQDKDKRGGIFDAVFTRGV ASIGMKKYAVGINAHGHVAQTTLLTARHDLKNKGLNDISTIIKQELTEGRA LALSHTYANVRISHVINLWGADFNAEGNLEAI YVTDSDANASIGMKKYAVGINAHGHVAISAKK IEGENIGAQVLGLFTLSSGKDIWQKLS (SEQ ID NO: 1239) |
| VRT-218 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFL DKAFPGLSARQLGVMPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGNLEAIYVTDSDAN ASIGMKKYAVGINAHGHVA ISAKKIEGENIGAQVLGLF TLSSGKDIWQKLS (SEQ ID NO: 970) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN LSHTYANVRISHVINLWGAYFLDKAFPGLSARQLGVMPDLVLDMFINGYYL DFNAEGNLEAIYVTDSDANVPKTQSTDVNRPYQDKDKRGGIFDAVFTRGV ASIGMKKYAVGINAHGHVAQTTLLTARHDLKNKGLNDISTIIKQELTEGRA LALSHTYANVRISHVINLWGADFNAEGNLEAI YVTDSDANASIGMKKYAVGINAHGHVAISAKK IEGENIGAQVLGLFTLSSGKDIWQKLS (SEQ ID NO: 1240) |
| VRT-219 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFL DKAFPGLSARQLGVMPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN LSHTYANVRISHVINLWGAYFLDKAFPGLSARQLGVMPDLVLDMFINGYYL |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | DFNAEGELEAIYVTDSDAN ASIGMKKYAVGINAHGHVA ISAKKIEGENIGAQVLGLF TLSSGKDQWQKLS (SEQ ID NO: 971) | NVPKTQSTDVNRPYQDKDKRGGIFDAVFTRGV QTTLLTARHDLKNKGLNDISTIIKQELTEGRA LALSHTYANVRISHVINLWGADFNAEGELEAI YVTDSDANASIGMKKYAVGINAHGHVAISAKK IEGENIGAQVLGLFTLSSGKDQWQKLS (SEQ ID NO: 1241) |
| VRT-220 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFR DKAFPGLSARQLGVFPDLV LDMFINGYYLNVPKTQSTD VNRPYQDKDKRGGIFDAVF TRGVQTTLLTARHDLKNKG NLLCGAATAGNMLHWWFDQNKTEIEAYLSKHP LNDISTIIKQELTEGRALA LSHTYANVRISHVINLWGA YFRDKAFPGLSARQLGVFPDLVLDMFINGYYL DENAEGNLEAIYVTDSDAN ASIGMKKYAVGINAHGHVA ISAKKIEGENIGAQVLGLF TLSSGKDIWQKLS (SEQ ID NO: 972) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN YFLDKAFPGLSARQLGVFPDLVLDMFINGYYL NVPKTQSTDVNRPYQDKDKRGGIFDAVFTRGV QTTLLTARHDLKNKGLNDISTIIKQELTEGRA LALSHTYANVRISHVINLWGADFNAEGELEAI YVTDSDANASIGMKKYAVGINAHGHVAISAKK IEGENIGAQVLGLFTLSSGKDIWQKLS (SEQ ID NO: 1242) |
| VRT-221 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFL DKAFPGLSARQLGVFPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGNLEAIYVTDSDAN ASIGMKKYAVGINAHGHVA ISAKKIEGENIGAQVLGLF TLSSGKDIWQKLS (SEQ ID NO: 973) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN YFLDKAFPGLSARQLGVFPDLVLDMFINGYYL NVPKTQSTDVNRPYQDKDKRGGIFDAVFTRGV QTTLLTARHDLKNKGLNDISTIIKQELTEGRA LALSHTYANVRISHVINLWGADFNAEGELEAI YVTDSDANASIGMKKYAVGINAHGHVAISAKK IEGENIGAQVLGLFTLSSGKDIWQKLS (SEQ ID NO: 1243) |
| VRT-222 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR ENNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFL DKAFPGLSARQLGVFPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGELEAIYVTDSDAN ASIGMKKYAVGINAHGHVA ISAKKIEGENIGAQVLGLF TLSSGKDQWQKLS (SEQ ID NO: 974) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFRENNEDVIHAPYLAHQGWYDITKAFDGKD NLLCGAATAGNMLHWWFDQNKTEIEAYLSKHP EKQKIIFGNQELFDLKAAIDTKDSQTNSQLFN YFLDKAFPGLSARQLGVFPDLVLDMFINGYYL NVPKTQSTDVNRPYQDKDKRGGIFDAVFTRGV QTTLLTARHDLKNKGLNDISTIIKQELTEGRA LALSHTYANVRISHVINLWGADFNAEGELEAI YVTDSDANASIGMKKYAVGINAHGHVAISAKK IEGENIGAQVLGLFTLSSGKDQWQKLS (SEQ ID NO: 1244) |
| VRT-223 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | QITSVWTKGVTPLTPEQFR EYNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFR DKAFPGLSARQLGVFPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGNLEAIYVTDSDTR | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFREYNEDVIHAPYLAHQGWYDITKAFDGKD NLLCGAATAGNMLHWWFDQNKTEIEAYLSKHP EKQKIIFGNQELFDLKAAIDTKDSQTNSQLFN YFRDKAFPGLSARQLGVFPDLVLDMFINGYYL NVPKTQSTDVNRPYQDKDKRGGIFDAVFTRGV |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | ASIGMKKYAVGINAHGHVA ISAKKIEGENIGAQVLGLF TLSSGKDIWQKLS (SEQ ID NO: 975) | QTTLLLTARHDLKNKGLNDISTIIKQELTEGRA LALSHTYANVRISHVINLWGADFNAEGNLEAI YVTDSDTRASIGMKKYAVGINAHGHVAISAKK IEGENIGAQVLGLFTLSSGKDIWQKLS (SEQ ID NO: 1245) |
| VRT-224 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR EYNEDVIHAPYLAHQGWYD ITKAFDGKDNLLCGAATAG NMLHWWFDQNKTEIEAYLS KEYKCKVSNKALKAPIEKTISKAKGQPREPQV KHPEKQKIIFGNQELFDLK AAIDTKDSQTNSQLFNYFL DKAFPGLSARQLGVFPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGNLEAIYVTDSDTR ASIGMKKYAVGINAHGHVA ISAKKIEGENIGAQVLGLF TLSSGKDIWQKLS (SEQ ID NO: 976) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFREYNEDVIHAPYLAHQGWYDITKAFDGKD NLLCGAATAGNMLHWWFDQNKTEIEAYLSKHP LNDISTIIKQELTEGRALA EKQKIIFGNQELFDLKAAIDTKDSQTNSQLFN YFLDKAFPGLSARQLGVFPDLVLDMFINGYYL NVPKTQSTDVNRPYQDKDKRGGIFDAVFTRGV QTTLLLTARHDLKNKGLNDISTIIKQELTEGRA LALSHTYANVRISHVINLWGADFNAEGNLEAI YVTDSDTRASIGMKKYAVGINAHGHVAISAKK IEGENIGAQVLGLFTLSSGKDIWQKLS (SEQ ID NO: 1246) |
| VRT-225 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | QITSVWTKGVTPLTPEQFR EYNEDVIHAPYLAHQGWYD ITKAFDGKDNLLCGAATAG NMLHWWFDQNKTEIEAYLS KHPEKQKIIFGNQELFDLK AAIDTKDSQTNSQLFNYFL DKAFPGLSARQLGVFPDLV LDMFINGYYLNVPKTQSTD VNRPYQDKDKRGGIFDAVF TRGVQTTLLTARHDLKNKG LNDISTIIKQELTEGRALA LSHTYANVRISHVINLWGA DFNAEGELEAIYVTDSDTR ASIGMKKYAVGINAHGHVA ISAKKIEGENIGAQVLGLF TLSSGKDQWQKLS (SEQ ID NO: 977) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGQITSVWTKGVTPLTP EQFREYNEDVIHAPYLAHQGWYDITKAFDGKD NLLCGAATAGNMLHWWFDQNKTEIEAYLSKHP EKQKIIFGNQELFDLKAAIDTKDSQTNSQLFN YFLDKAFPGLSARQLGVFPDLVLDMFINGYYL NVPKTQSTDVNRPYQDKDKRGGIFDAVFTRGV QTTLLLTARHDLKNKGLNDISTIIKQELTEGRA LALSHTYANVRISHVINLWGADFNAEGELEAI YVTDSDTRASIGMKKYAVGINAHGHVAISAKK IEGENIGAQVLGLFTLSSGKDQWQKLS (SEQ ID NO: 1247) |
| VRT-226 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDND KCAAAVAANMFHYWLDINR DNVDRFLRQNPEKHGIIEL PDGQLKLSDFLNTYESDHG YRDKSKLFDFISNNFNGPV WTDKLLDNYINGYAYNSKY GRTIEDSTKNTSKINFFKE VFNEKILTNIHSIRNQNEF SVLLSEALYTGKAIGLSYG PAGLRHSLGHIISVWGADL DADGNVVAIYVTDSDDKKL TIGDERVGLKRYKISTDDE NRLRLTAYEETHNTGGQVR GLWTDLTGKYAWADYFDKT EQTGTDQAEQ (SEQ ID NO: 978) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDNDKCA AAVAANMFHYWLDINRDNVDRFLRQNPEKHGI IELPDGQLKLSDFLNTYESDHGYRDKSKLFDF ISNNFNGPVWTDKLLDNYINGYAYNSKYGRTI EDSTKNTSKINFFKEVFNEKILTNIHSIRNQN EFSVLLSEALYTGKAIGLSYGPAGLRHSLGHI ISVWGADLDADGNVVAIYVTDSDDKKLTIGDE RVGLKRYKISTDDENRLRLTAYEETHNTGGQV RGLWTDLTGKYAWADYFDKTEQTGTDQAEQ (SEQ ID NO: 1248) |
| VRT-227 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDND KCAAAVAANMFHYWLDINR DNVDRFLRQNPEKHGIIEL PDGQLKLSDFLNTYESDHG YRDKSKLFDFISENFNGPV WTDKLLDNYINGYAYNSKY GRTIEDSTKNTSKINFFKE VFNEKILTNIHSIRNQNEF SVLLIEALYTGKAIGLSYG PAGLRHGLGHIISVWGADL ISENFNGPVWTDKLLDNYINGYAYNSKYGRTI | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDNDKCA AAVAANMFHYWLDINRDNVDRFLRQNPEKHGI IELPDGQLKLSDFLNTYESDHGYRDKSKLFDF |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | DADGNVVAIYVTDSDDKKL TIGDERVGLKRYKISTDDE NRLRLTAYEETHNTGGQVR GLWTLDTGKYAWADYFDKT EQTGTDQAEQ (SEQ ID NO: 979) | EDSTKNTSKINFFKEVFNEKILTNIHSIRNQN EFSVLLIEALYTGKAIGLSYGPAGLRHGLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1249) |
| VRT-228 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDND KCAAAVAANMFHYWLDINR DNVDRFLRQNPEKHGIIEL PDEQLKLSDFLNTYESDHG YRDKSKLFDFISNNFNKPV WTDKLLDNYINGYAYNSKY GRTIEDSTKNTSKINFFKE VFNEKILTNIHSIRNQNEF AAVAANMFHYWLDINRDNV DRFLRQNPEKHGIIELPDE QLKLSDFLNTYESDHGYRD KSKLFDFISNNFNKPVWTD KLLDNYINGYAYNSKYGRT IEDSTKNTSKINFFKEVFN EKILTNIHSIRNQNEFAAV AANMFHYWLDINRDNVDRF LRQNPEKHGIIELPDEQLK LSDFLNTYESDHGYRDKSK LFDFISNNFNKPVWTDKLL DNYINGYAYNSKYGRTIED STKNTSKINFFKEVFNEKI LTNIHSIRNQNEFAAVAAN MFHYWLDINRDNVDRFLRQ NPEKHGIIELSVLLSEALYTGKAIGLSYG IELPDEQLKLSDFLNTYESDHGYRDKSKLFDF PAGLRHGLGHIISVWGADL ISNNFNKPVWTDKLLDNYINGYAYNSKYGRTI DADGNVVAIYVTDSDDKKL EDSTKNTSKINFFKEVFNEKILTNIHSIRNQN TIGDERVGLKRYKISTDDE EFSVLLIEALYTGKAIGLSYGPAGLRHGLGHI NRLRLTAYEETHNTGGQVR ISVWGADLDADGNVVAIYVTDSDDKKLTIGDE GLWTLDTGKYAWADYFDKT RVGLKRYKISTDDENRLRLTAYEETHNTGGQV EQTGTDQAEQ (SEQ ID RGLWTLDTGKYAWADYFDKTEQTGTDQAEQ NO: 980) (SEQ ID NO: 1250) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDNDKCA AAVAANMFHYWLDINRDNVDRFLRQNPEKHGI IELPDEQLKLSDFLNTYESDHGYRDKSKLFDF ISNNFNKPVWTDKLLDNYINGYAYNSKYGRTI EDSTKNTSKINFFKEVFNEKILTNIHSIRNQN EFSVLLIEALYTGKAIGLSYGPAGLRHGLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1250) |
| VRT-229 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKMQNVVYTKWLDGVDV KDHDFRKIVDGNSAYYATP LLNGRGFYDINKDFNRDND KCAAAVAANMFHYWLDINR DNVDRFLRQNPEKHGIIEL PDEQLKLSDFLNTYESDHG YRDKSKLFDFISENFNKPV WTDKLLDNYINGYAYNSKY GRTIEDSTKNTSKINFFKE VFNEKILTNIHSIRNQNEF AAVAANMFHYWLDINRDNV DRFLRQNPEKHGIIELPDE QLKLSDFLNTYESDHGYRD KSKLFDFISENFNKPVWTD KLLDNYINGYAYNSKYGRT IEDSTKNTSKINFFKEVFN EKILTNIHSIRNQNEFSVLLIEALYTGKAIGLSYG IELPDEQLKLSDFLNTYESDHGYRDKSKLFDF PAGLRHGLGHIISVWGADL ISENFNKPVWTDKLLDNYINGYAYNSKYGRTI DADGNVVAIYVTDSDDKKL EDSTKNTSKINFFKEVFNEKILTNIHSIRNQN TIGDERVGLKRYKISTDDE EFSVLLIEALYTGKAIGLSYGPAGLRHGLGHI NRLRLTAYEETHNTGGQVR ISVWGADLDADGNVVAIYVTDSDDKKLTIGDE GLWTLDTGKYAWADYFDKT RVGLKRYKISTDDENRLRLTAYEETHNTGGQV EQTGTDQAEQ (SEQ ID RGLWTLDTGKYAWADYFDKTEQTGTDQAEQ NO: 981) (SEQ ID NO: 1251) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKMQNVVYTKWLDGVDVKDHDFRKIV DGNSAYYATPLLNGRGFYDINKDFNRDNDKCA AAVAANMFHYWLDINRDNVDRFLRQNPEKHGI IELPDEQLKLSDFLNTYESDHGYRDKSKLFDF ISENFNKPVWTDKLLDNYINGYAYNSKYGRTI EDSTKNTSKINFFKEVFNEKILTNIHSIRNQN EFSVLLIEALYTGKAIGLSYGPAGLRHGLGHI ISVWGADLDADGNVVAIYVTDSDDKKLTIGDE RVGLKRYKISTDDENRLRLTAYEETHNTGGQV RGLWTLDTGKYAWADYFDKTEQTGTDQAEQ (SEQ ID NO: 1251) |
| VRT-230 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDTLLCGAATAGNMLH WWFDQNKEQIENYLKKHPE KQKINFKGEQLFDVKEAID TKDSQLDSKLFEYFKEKAF PSLSTKHLGVFPDHVIDMF INGYRLSLLNHGPTPVKRG SKDKRGGIFDAVFTRGVQS KLLTNRHDFKEEKTLKEISD LIKQELTEGKALGISHTYA NVRINHVINLWGADFDAEG NLEAIYVTDSDTEASIGMK KYVVGVNKNGKVAISAKEI EEDNIGAQVLGLFTLSTGQ DIWNQTN (SEQ ID NO: 982) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDTLLC GAATAGNMLHWWFDQNKEQIENYLKKHPEKQK INFKGEQLFDVKEAIDTKDSQLDSKLFEYFKE KAFPSLSTKHLGVFPDHVIDMFINGYRLSLLN HGPTPVKRGSKDKRGGIFDAVFTRGVQSKLLT NRHDFKEEKTLKEISDLIKQELTEGKALGISHT YANVRINHVINLWGADFDAEGNLEAIYVTDSD TEASIGMKKYVVGVNKNGKVAISAKEIEEDNI GAQVLGLFTLSTGQDIWNQTN (SEQ ID NO: 1252) |
| VRT-231 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG (SEQ ID NO: 1020) | VTSVWTKGVTPPTNFTYGE DVLHAPYVANQGWYDITKT FNGKDTLLCGAATAGNMLH WWFDQNKEQIENYLKKHPE KQKINFKGEQLFDVKEAID TKDSQLDSKLFEYFKEKAF PSLSTKHLGVFPDHVIDMF INGYRLSLLNHGPTPVKRG SKDKRGGIFDAVFTRGVQS KLLTNRHDFKEEKTLKEISD GAATAGNMLHWWFDQNKEQIENYLKKHPEKQK LIKQELTEGKALGISHTYA INFKGEQLFDVKEAIDTKDSQLDSKLFEYFKE | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDTLLC |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | NARINHVINLWGADFDAEG NLEAIYVTDSDTEPSIGMK KYVVGVNKNGKVAISAKEI NRHDFKEKTLKEISDLIKQELTEGKALGISHT EEDNIGAQVLGLFTLSTGQ DIWNQTN (SEQ ID NO: 983) | KAFPSLSTKHLGVFPDHVIDMFINGYRLSLLN HGPTPVKRGSKDKRGGIFDAVFTRGVQSKLLT NRHDFKEKTLKEISDLIKQELTEGKALGISHT YANARINHVINLWGADFDAEGNLEAIYVTDSD TEPSIGMKKYVVGVNKNGKVAISAKEIEEDNI GAQVLGLFTLSTGQDIWNQTN (SEQ ID NO: 1253) |
| VRT-232 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKL FNGKDTLLCGAATAGNMLH WWFDQNKEQIENYLKKHPE KQKINFKGEQLFDVKEAID TKDSQLDSKLFEYFLEKAF PSLSTKHLGVFPDHVIDMF INGYRLSLLNHGPTPVKRG SKDKRGGIFDAVFTRGVQS KLLTNRHDFKEKTLKEISD LIKQELTEGKALGISHTYA NARINHVINLWGADFDAEG NLEAIYVTDSDTEPSIGMK KYVVGVNKNGKVAISAKEI EEDNIGAQVLGLFTLSTGQ DIWNQTN (SEQ ID NO: 984) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDTLLC GAATAGNMLHWWFDQNKEQIENYLKKHPEKQK INFKGEQLFDVKEAIDTKDSQLDSKLFEYFLE KAFPSLSTKHLGVFPDHVIDMFINGYRLSLLN HGPTPVKRGSKDKRGGIFDAVFTRGVQSKLLT NRHDFKEKTLKEISDLIKQELTEGKALGISHT YANARINHVINLWGADFDAEGNLEAIYVTDSD TEPSIGMKKYVVGVNKNGKVAISAKEIEEDNI GAQVLGLFTLSTGQDIWNQTN (SEQ ID NO: 1254) |
| VRT-233 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDTLLCGAATAGNMLH WWFDQNKEQIENYLKKHPE KQKINFNGEQLEDVKEAID TKDSQLDSKLFEYFKEKAF PSLSTKHLGVFPDHVIDMF DKSRWQQGNVFSCSVMHEALHNHYTQKSLSLS PGGGGSGGGGSGGGGSGVTSVWTKGVTPPTNF SKDKRGGIFDAVFTRGVQS KLLTNRHDFKEKTLKEISD LIKQELTEGKALGISHTYA NVRINHVINLWGADFDAEG NLEAIYVTDSDTEASIGMK KYVVGVNSNGKVAISAKEI EEDNIGAQVLGLFTLSTGQ DIWNQTN (SEQ ID NO: 985) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV TYGEDVLHAPYVANQGWYDITKTFNGKDTLLC GAATAGNMLHWWFDQNKEQIENYLKKHPEKQK LIKQELTEGKALGISHTYA INFNGEQLFDVKEAIDTKDSQLDSKLFEYFKE NVRINHVINLWGADFDAEG KAFPSLSTKHLGVFPDHVIDMFDKSRWQQGNVFSCSVMHEALHNHYTQKSLSLS NLEAIYVTDSDTEASIGMK HGPTPVKRGSKDKRGGIFDAVFTRGVQSKLLT NRHDFKEKTLKEISDLIKQELTEGKALGISHT YANVRINHVINLWGADFDAEGNLEAIYVTDSD TEASIGMKKYVVGVNSNGKVAISAKEIEEDNI GAQVLGLFTLSTGQDIWNQTN (SEQ ID NO: 1255) |
| VRT-234 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTNFTYGE DVLHAPYVANQGWYDITKT FNGKDTLLCGAATAGNMLH WWFDQNKEQIENYLKKHPE KQKINFNGEQLEDVKEAID TKDSQLDSKLFEYFKEKAF PSLSTKHLGVFPDHVIDMF INGYRLSLLNHGPTPVKRG SKDKRGGIFDAVFTRGVQS KLLTNRHDFKEKTLKEISD LIKQELTEGKALGISHTYA NARINHVINLWGADFDAEG NLEAIYVTDSDTEPSIGMK KYVVGVNSNGKVAISAKEI EEDNIGAQVLGLFTLSTGQ DIWNQTN (SEQ ID NO: 986) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKTFNGKDTLLC GAATAGNMLHWWFDQNKEQIENYLKKHPEKQK INFNGEQLFDVKEAIDTKDSQLDSKLFEYFKE KAFPSLSTKHLGVFPDHVIDMFINGYRLSLLN HGPTPVKRGSKDKRGGIFDAVFTRGVQSKLLT NRHDFKEKTLKEISDLIKQELTEGKALGISHT YANARINHVINLWGADFDAEGNLEAIYVTDSD TEPSIGMKKYVVGVNSNGKVAISAKEIEEDNI GAQVLGLFTLSTGQDIWNQTN (SEQ ID NO: 1256) |
| VRT-235 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | VTSVWTKGVTPPTNFTYGE DVLHAPYVANQGWYDITKL FNGKDTLLCGAATAGNMLH WWFDQNKEQIENYLKKHPE KQKINFNGEQLFDVKEAID TKDSQLDSKLFEYFLEKAF PSLSTKHLGVFPDHVIDMF INGYRLSLLNHGPTPVKRG SKDKRGGIFDAVFTRGVQS KLLTNRHDFKEKTLKEISD LIKQELTEGKALGISHTYA NARINHVINLWGADFDAEG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTNF TYGEDVLHAPYVANQGWYDITKLFNGKDTLLC GAATAGNMLHWWFDQNKEQIENYLKKHPEKQK INFNGEQLFDVKEAIDTKDSQLDSKLFEYFLE KAFPSLSTKHLGVFPDHVIDMFINGYRLSLLN |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | NLEAIYVTDSDTEPSIGMK KYVVGVNSNGKVAISAKEI EEDNIGAQVLGLFTLSTGQ DIWNQTN (SEQ ID NO: 987) | HGPTPVKRGSKDKRGGIFDAVFTRGVQSKLLT KYVVGVNSNGKVAISAKEI NRHDFKEKTLKEISDLIKQELTEGKALGISHT YANARINHVINLWGADFDAEGNLEAIYVTDSD TEPSIGMKKYVVGVNSNGKVAISAKEIEEDNI GAQVLGLFTLSTGQDIWNQTN (SEQ ID NO: 1257) |
| VRT-236 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKT FNGKDTLLCGAATAGNMLH WWFDQNKEQIENYLKKHPE KQKIIFKNQELFDLKAAID TKDSQLDSKLFEYFKEKAF WESNGQPENNYKTTPPVLDSDGSFFLYSKLTV PSLSTKHLGVFPDHVIDMF INGYRLSLLNHGPTPVKRG SKDKRGGIFDAVFTRGVQS KLLTNRHDFKEKTLKEISD GAATAGNMLHWWFDQNKEQIENYLKKHPEKQK LIKQELTEGKALGISHTYA IIFKNQELFDLKAAIDTKDSQLDSKLFEYFKE NVRINHVINLWGADFDAEG KAFPSLSTKHLGVFPDHVIDMFINGYRLSLLN NLEAIYVTDSDTEASIGMK HGPTPVKRGSKDKRGGIFDAVFTRGVQSKLLT KYVVGVNKNGKVAISAKEI NRHDFKEKTLKEISDLIKQELTEGKALGISHT EEDNIGAQVLGLFTLSTGQ YANARINHVINLWGADFDAEGNLEAIYVTDSD DIWNQTN (SEQ ID NO: 988) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDTLLC GAATAGNMLHWWFDQNKEQIENYLKKHPEKQK IIFKNQELFDLKAAIDTKDSQLDSKLFEYFKE KAFWESNGQPENNYKTTPPVLDSDGSFFLYSK LTVPSLSTKHLGVFPDHVIDMFINGYRLSLLN HGPTPVKRGSKDKRGGIFDAVFTRGVQSKLLT NRHDFKEKTLKEISDLIKQELTEGKALGISHT TEASIGMKKYVVGVNKNGKVAISAKEIEEDNI GAQVLGLFTLSTGQDIWNQTN (SEQ ID NO: 1258) |
| VRT-237 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKT FNGKDTLLCGAATAGNMLH WWFDQNKEQIENYLKKHPE KEYKCKVSNKALKAPIEKTISKAKGQPREPQV KQKIIFKNQELFDLKAAID YTLPPSRDELTKNQVSLTCLVKGFYPSDIAVE TKDSQLDSKLFEYFKEKAF WESNGQPENNYKTTPPVLDSDGSFFLYSKLTV PSLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTDF SKDKRGGIFDAVFTRGVQS IYGEDVLHAPYKAGQGWYDITKTFNGKDTLLC KLLTNRHDFKEKTLKEISD GAATAGNMLHWWFDQNKEQIENYLKKHPEKQK LIKQELTEGKALGISHTYA IIFKNQELFDLKAAIDTKDSQLDSKLFEYFKE NARINHVINLWGADFDAEG KAFPSLSTKHLGVFPDHVIDMFINGYRLSLLN NLEAIYVTDSDTEPSIGMK HGPTPVKRGSKDKRGGIFDAVFTRGVQSKLLT KYVVGVNKNGKVAISAKEI NRHDFKEKTLKEISDLIKQELTEGKALGISHT EEDNIGAQVLGLFTLSTGQ YANARINHVINLWGADFDAEGNLEAIYVTDSD DIWNQTN (SEQ ID NO: 989) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG TEPSIGMKKYVVGVNKNGKVAISAKEIEEDNI GAQVLGLFTLSTGQDIWNQTN (SEQ ID NO: 1259) |
| VRT-238 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDTLLCGAATAGNMLH WWFDQNKEQIENYLKKHPE KEYKCKVSNKALKAPIEKTISKAKGQPREPQV KQKIIFKNQELFDLKAAID YTLPPSRDELTKNQVSLTCLVKGFYPSDIAVE TKDSQLDSKLFEYFLEKAF WESNGQPENNYKTTPPVLDSDGSFFLYSKLTV PSLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTDF SKDKRGGIFDAVFTRGVQS IYGEDVLHAPYKAGQGWYDITKLFNGKDTLLC KLLTNRHDFKEKTLKEISD GAATAGNMLHWWFDQNKEQIENYLKKHPEKQK LIKQELTEGKALGISHTYA IIFKNQELFDLKAAIDTKDSQLDSKLFEYFLE NARINHVINLWGADFDAEG KAFPSLSTKHLGVFPDHVIDMFINGYRLSLLN NLEAIYVTDSDTEPSIGMK HGPTPVKRGSKDKRGGIFDAVFTRGVQSKLLT KYVVGVNKNGKVAISAKEI NRHDFKEKTLKEISDLIKQELTEGKALGISHT EEDNIGAQVLGLFTLSTGQ YANARINHVINLWGADFDAEGNLEAIYVTDSD DIWNQTN (SEQ ID NO: 990) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDTLLC GAATAGNMLHWWFDQNKEQIENYLKKHPEKQK IIFKNQELFDLKAAIDTKDSQLDSKLFEYFLE KAFWESNGQPENNYKTTPPVLDSDGSFFLYSK LTVPSLSTKHLGVFPDHVIDMFINGYRLSLLN HGPTPVKRGSKDKRGGIFDAVFTRGVQSKLLT NRHDFKEKTLKEISDLIKQELTEGKALGISHT TEPSIGMKKYVVGVNKNGKVAISAKE IEEDNI GAQVLGLFTLSTGQDIWNQTN (SEQ ID NO: 1260) |
| VRT-239 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | VTSVWTKGVTPPTDFIYGE DVLHAPYKAGQGWYDITKT FNGKDTLLCGAATAGNMLH WWFDQNKEQIENYLKKHPE KEYKCKVSNKALKAPIEKTISKAKGQPREPQV KQKIIFNNQELFDLKAAID YTLPPSRDELTKNQVSLTCLVKGFYPSDIAVE TKDSQLDSKLFEYFKEKAF WESNGQPENNYKTTPPVLDSDGSFFLYSKLTV PSLSTKHLGVFPDHVIDMF DKSRWQQGNVFSCSVMHEALHNHYTQKSLSLS INGYRLSLLNHGPTPVKRG PGGGGSGGGGSGGGGSGVTSVWTKGVTPPTDF SKDKRGGIFDAVFTRGVQS IYGEDVLHAPYKAGQGWYDITKTFNGKDTLLC KLLTNRHDFKEKTLKEISD GAATAGNMLHWWFDQNKEQIENYLKKHPEKQK LIKQELTEGKALGISHTYA IIFNNQELFDLKAAIDTKDSQLDSKLFEYFKE NVRINHVINLWGADFDAEG KAFPSLSTKHLGVFPDHVIDMFINGYRLSLLN NLEAIYVTDSDTEASIGMK HGPTPVKRGSKDKRGGIFDAVFTRGVQSKLLT | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | KYVVGVNSNGKVAISAKEI EEDNIGAQVLGLFTLSTGQ DIWNQTN (SEQ ID NO: 991) | NRHDFKEKTLKEISDLIKQELTEGKALGISHT YANVRINHVINLWGADFDAEGNLEAIYVTDSD TEASIGMKKYVVGVNSNGKVAISAKEIEEDNI GAQVLGLFTLSTGQDIWNQTN (SEQ ID NO: 1261) |
| VRT-240 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKT FNGKDTLLCGAATAGNMLH WWFDQNKEQIENYLKKHPE KQKIIFNNQELFDLKAAID TKDSQLDSKLFEYFKEKAF PSLSTKHLGVFPDHVIDMF INGYRLSLLNHGPTPVKRG SKDKRGGIFDAVFTRGVQS KLLTNRHDFKEKTLKEISD LIKQELTEGKALGISHTYA NARINHVINLWGADFDAEG NLEAIYVTDSDTEPSIGMK KYVVGVNSNGKVAISAKEI EEDNIGAQVLGLFTLSTGQ DIWNQTN (SEQ ID NO: 992) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKTFNGKDTLLC GAATAGNMLHWWFDQNKEQIENYLKKHPEKQK IIFNNQELFDLKAAIDTKDSQLDSKLFEYFKE KAFPSLSTKHLGVFPDHVIDMFINGYRLSLLN HGPTPVKRGSKDKRGGIFDAVFTRGVQSKLLT NRHDFKEKTLKEISDLIKQELTEGKALGISHT YANARINHVINLWGADFDAEGNLEAIYVTDSD TEPSIGMKKYVVGVNSNGKVAISAKEIEEDNI GAQVLGLFTLSTGQDIWNQTN (SEQ ID NO: 1262) |
| VRT-241 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPTDFIYGE DVLHAPYKAGQGWYDITKL FNGKDTLLCGAATAGNMLH WWFDQNKEQIENYLKKHPE KQKIIFNNQELFDLKAAID TKDSQLDSKLFEYFLEKAF PSLSTKHLGVFPDHVIDMF INGYRLSLLNHGPTPVKRG SKDKRGGIFDAVFTRGVQS KLLTNRHDFKEKTLKEISD LIKQELTEGKALGISHTYA NARINHVINLWGADFDAEG NLEAIYVTDSDTEPSIGMK KYVVGVNSNGKVAISAKEI EEDNIGAQVLGLFTLSTGQ DIWNQTN (SEQ ID NO: 993) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPTDF IYGEDVLHAPYKAGQGWYDITKLFNGKDTLLC GAATAGNMLHWWFDQNKEQIENYLKKHPEKQK IIFNNQELFDLKAAIDTKDSQLDSKLFEYFLE KAFPSLSTKHLGVFPDHVIDMFINGYRLSLLN HGPTPVKRGSKDKRGGIFDAVFTRGVQSKLLT NRHDFKEKTLKEISDLIKQELTEGKALGISHT YANARINHVINLWGADFDAEGNLEAIYVTDSD TEPSIGMKKYVVGVNSNGKVAISAKEIEEDNI GAQVLGLFTLSTGQDIWNQTN (SEQ ID NO: 1263) |
| VRT-242 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DVFHAPYKANQGWYDITKT FNGKDNLLCGAATAGNMLH WWFDQNKEYIEAYLKKHPE KQKIIFGDQELLDVRKAIN TKGSQKNSELFNYFRDKAF WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYKANQGWYDITKTFNGKDNLLC GAATAGNMLHWWFDQNKEYIEAYLKKHPEKQK IIFGDQELLDVRKAINTKGSQKNSELFNYFRD KAFPNLSARRLGVFPDLVLDMFINGYYLNVTK TQTTDVNRTYQEKDKRGGIFDAVFTRGVQSKL MKKYVVGVNSAGKVAISAK LTSRHDFKEKGLKEISDLIKQELTEGKALGLS HTYANVGINHVINLWGADFDSDGNLKAIYVTD SDTNASIGMKKYVVGVNSAGKVAISAKEIKED NIGAQVLGLFTLSTGQDIWNQTN (SEQ ID NO: 1264) |
| VRT-243 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGGSGG GGSGGGG SG (SEQ ID NO: 1020) | VTSVWTKGVTPPADFTQGE DVFHAPYKANQGWYDITKT FNGKDNLLCGAATAGNMLH WWFDQNKEYIEAYLKKHPE KQKIIFGDQELLDVRKAIN TKGSQKNSELFNYFRDKAF PTLSARRLGVFPDLVLDMF INGYYLNVTKTQTTDVNRT YQEKDKRGGIFDAVFTRGV QSKLLTSRHDFKEKGLKEI TANVGINHVINLWGADFDS DGNLKAIYVTDSDTNASIG MKKYVVGVNSAGKVAISAK | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYKANQGWYDITKTFNGKDNLLC GAATAGNMLHWWFDQNKEYIEAYLKKHPEKQK IIFGDQELLDVRKAINTKGSQKNSELFNYFRD KAFPTLSARRLGVFPDLVLDMFINGYYLNVTK TQTTDVNRTYQEKDKRGGIFDAVFTRGVQSKL LTSRHDFKEKGLKEISDLIKQELTEGKALGLS |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | EIKEDNIGAQVLGLFTLST GQDIWNQTN (SEQ ID NO: 995) | HTTANVGINHVINLWGADFDSDGNLKAIYVTD SDTNASIGMKKYVVGVNSAGKVAISAKEIKED NIGAQVLGLFTLSTGQDIWNQTN (SEQ ID NO: 1265) |
| VRT-244 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DVFHAPYKANQGWYDITKT FNRKDNLLCGAATAGNMLH WWFDQNKEYIEAYLKKHPE KQKIIFGDQELLDVRKAIN TKGSQKNSELFNYFRDKAF PNLSARRLGVFPDLVLDMF INGYYLNVTKTQTTDVNRT YQEKDKRGGIFDAVFTRGV QSKLLTSRHDFKEKGLKEI SDLIKQELTEGKALGLSHT YANVGINHVINLWGADFDS DGNLKAIYVTDSDTRASIG MKKYVVGVNAAGKVAISAK EIKEDNIGAQVLGLFTLST GQDIWNQTN (SEQ ID NO: 996) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYKANQGWYDITKTFNRKDNLLC GAATAGNMLHWWFDQNKEYIEAYLKKHPEKQK IIFGDQELLDVRKAINTKGSQKNSELFNYFRD KAFPNLSARRLGVFPDLVLDMFINGYYLNVTK TQTTDVNRTYQEKDKRGGIFDAVFTRGVQSKL LTSRHDFKEKGLKEISDLIKQELTEGKALGLS HTYANVGINHVINLWGADFDSDGNLKAIYVTD SDTRASIGMKKYVVGVNAAGKVAISAKEIKED NIGAQVLGLFTLSTGQDIWNQTN (SEQ ID NO: 1266) |
| VRT-245 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | VTSVWTKGVTPPADFTQGE DVFHAPYKANQGWYDITKT FNRKDNLLCGAATAGNMLH WWFDQNKEYIEAYLKKHPE KQKIIFGDQELLDVRKAIN TKGSQKNSELFNYFRDKAF PTLSARRLGVFPDLVLDMF INGYYLNVTKTQTTDVNRT YQEKDKRGGIFDAVFTRGV QSKLLTSRHDFKEKGLKEI SDLIKQELTEGKALGLSHT TANVGINHVINLWGADFDS DGNLKAIYVTDSDTRASIG MKKYVVGVNAAGKVAISAK EIKEDNIGAQVLGLFTLST GQDIWNQTN (SEQ ID NO: 997) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGVTSVWTKGVTPPADF TQGEDVFHAPYKANQGWYDITKTFNRKDNLLC GAATAGNMLHWWFDQNKEYIEAYLKKHPEKQK IIFGDQELLDVRKAINTKGSQKNSELFNYFRD KAFPTLSARRLGVFPDLVLDMFINGYYLNVTK TQTTDVNRTYQEKDKRGGIFDAVFTRGVQSKL LTSRHDFKEKGLKEISDLIKQELTEGKALGLS HTTANVGINHVINLWGADFDSDGNLKAIYVTD SDTRASIGMKKYVVGVNAAGKVAISAKEIKED NIGAQVLGLFTLSTGQDIWNQTN (SEQ ID NO: 1267) |
| VRT-246 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFR DKAFPGLSARQLGVMPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF TLSTGQDIWQKLS (SEQ ID NO: 998) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN LSHTYANVRINHVINLWGAYFRDKAFPGLSARQLGVMPDLVLDMFINGYYL DFDAEGNLIAIYVTDSDAN NLGKTQSTDVNRPYQDKDKRGGIFDAVFTRGV ASIGMKKYAVGVNANGKVA QTTLLTARHDLKNKGLNEISDLIKQELTEGKA ISAKKIEGDNIGAQVLGLF LALSHTYANVRINHVINLWGADFDAEGNLIAI TLSTGQDIWQKLS (SEQ YVTDSDANASIGMKKYAVGVNANGKVAISAKK ID NO: 998) IEGDNIGAQVLGLFTLSTGQDIWQKLS (SEQ ID NO: 1268) |
| VRT-247 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGGSGG GGSGGGG SG (SEQ ID NO: 1020) | TITSVWTKGVTPPTEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVMPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVMPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGNLIAI |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | TLSTGQDIWQKLS (SEQ ID NO: 999) | YVTDSDANASIGMKKYAVGVNANGKVAISAKK IEGDNIGAQVLGLFTLSTGQDIWQKLS (SEQ ID NO: 1269) |
| VRT-248 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVMPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGELIAIYVTDSDAN ASIGMKKYAVGVNANGKVA ISAKKIEGDNIGAQVLGLF TLSTGQDQWQKLS (SEQ ID NO: 1000) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVMPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGELIAI YVTDSDANASIGMKKYAVGVNANGKVAISAKK IEGDNIGAQVLGLFTLSTGQDQWQKLS (SEQ ID NO: 1270) |
| VRT-249 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFR DKAFPGLSARQLGVPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF TLSTGQDIWQKLS (SEQ ID NO: 1001) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN YFRDKAFPGLSARQLGVPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYAVGVNANGKVAISAKK IEGDNIGAQVLGLFTLSTGQDIWQKLS (SEQ ID NO: 1271) |
| VRT-250 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDAN ASIGMKKYAVGVNANGKVA ISAKKIEGDNIGAQVLGLF TLSTGQDIWQKLS (SEQ ID NO: 1002) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGNLIAI YVTDSDANASIGMKKYAVGVNANGKVAISAKK IEGDNIGAQVLGLFTLSTGQDIWQKLS (SEQ ID NO: 1272) |
| VRT-251 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP | GGGGSGG GGSGGGG SG | TITSVWTKGVTPPTPEDFR ENNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVPDLV LDMFINGYYLNLPKTQSTD VNRPYQDKDKRGGIFDAVF TRGVQTTLLTARHDLKNKG LNEISDLIKQELTEGKALA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYVANQGWYDITKTFDGKD NLLCGAATAGNMLHWWFDQNKEEIERYLKKHP EKQKIIFGNQELFDVKAAIDTKDSQTNSKLFN |

TABLE 8-continued

| ID | N-terminus Fc Moiety | Linker | C-terminus Protease Moiety | Full length Sequence |
|---|---|---|---|---|
| | SDIAVEWESNGQPE NNYKTTPPVLDSDG SFFLYSKLTVDKSR WQQGNVFSCSVMHE ALHNHYTQKSLSLS PG (SEQ ID NO: 23) | | LSHTYANVRINHVINLWGA DFDAEGELIAIYVTDSDAN ASIGMKKYAVGVNANGKVA ISAKKIEGDNIGAQVLGLF TLSTGQDQWQKLS (SEQ ID NO: 1003) | YFLDKAFPGLSARQLGVFPDLVLDMFINGYYL NLPKTQSTDVNRPYQDKDKRGGIFDAVFTRGV QTTLLTARHDLKNKGLNEISDLIKQELTEGKA ISAKKIEGDNIGAQVLGLFTLSTGQDQWQKLS (SEQ ID NO: 1273) |
| VRT-252 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR EYNEDVLHAPYVANQGWYD ITKTFDGKDNLLCGAATAG NMLHWWFDQNKEEIERYLK KHPEKQKIIFGNQELFDVK AAIDTKDSQTNSKLFNYFR WESNGQPENNYKTTPPVLDSDGSFFLYSKLTV DKAFPGLSARQLGVFPDLV LDMFINGYYLNLKTQSTD VNRPYQDKDKRGGIFDAVF TRGVQTTLLTARHDLKNKG LNEISDLIKQELTEGKALA EKQKIIFGNQELFDVKAAIDTKDSQTNSKLFN LSHTYANVRINHVINLWGA DFDAEGNLIAIYVTDSDTR ASIGMKKYAVGVNANGKVA ISAKKIEGDNIGAQVLGLF TLSTGQDIWQKLS (SEQ ID NO: 1004) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKAFPGLSARQLGVFPDLV DKSRWQQGNVFSCSVMHEALHNHYTQKSLSLS PGGGGSGGGGSGGGGSGTITSVWTKGVTPPTP EDFREYNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVFPDLVLDMFINGYYL NLPKTQSTDVNRPYQDKDKRGGIFDAVFTRGV QTTLLTARHDLKNKGLNEISDLIKQELTEGKA ISAKKIEGDNIGAQVLGLFTLSTGQDIWQKLS (SEQ ID NO: 1274) |
| VRT-253 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR EYNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVFPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGNLIAIYVTDSDTR ASIGMKKYAVGVNANGKVA ISAKKIEGDNIGAQVLGLF TLSTGQDIWQKLS (SEQ ID NO: 1005) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKAFPGLSARQLGVFPDLV DKSRWQQGNVFSCSVMHEALHNHYTQKSLSLS PGGGGSGGGGSGGGGSGTITSVWTKGVTPPTP EDFREYNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVFPDLVLDMFINGYYL NLPKTQSTDVNRPYQDKDKRGGIFDAVFTRGV QTTLLTARHDLKNKGLNEISDLIKQELTEGKA ISAKKIEGDNIGAQVLGLFTLSTGQDIWQKLS (SEQ ID NO: 1275) |
| VRT-254 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR EYNEDVLHAPYVANQGWYD ITKTFDGKDNLLCGAATAG NMLHWWFDQNKEEIERYLK KHPEKQKIIFGNQELFDVK AAIDTKDSQTNSKLFNYFL DKAFPGLSARQLGVFPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGELIAIYVTDSDTR ASIGMKKYAVGVNANGKVA ISAKKIEGDNIGAQVLGLF TLSTGQDWQKLS (SEQ ID NO: 1006) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKAFPGLSARQLGVFPDLV DKSRWQQGNVFSCSVMHEALHNHYTQKSLSLS PGGGGSGGGGSGGGGSGTITSVWTKGVTPPTP EDFREYNEDVLHAPYVANQGWYDITKTFDGKD NLLCGAATAGNMLHWWFDQNKEEIERYLKKHP EKQKIIFGNQELFDVKAAIDTKDSQTNSKLFN YFLDKAFPGLSARQLGVFPDLVLDMFINGYYL NLPKTQSTDVNRPYQDKDKRGGIFDAVFTRGV QTTLLTARHDLKNKGLNEISDLIKQELTEGKA ISAKKIEGDNIGAQVLGLFTLSTGQDWQKLS (SEQ ID NO: 1276) |
| VRT-255 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAGQPREP QVYTLPPSRDELTK NQVSLTCLVKGFYP SDIAVEWESNGQPE | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFR WESNGQPENNYKTTPPVLDSDGSFFLYSKLTV DKAFPGLSARQLGVMPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKAFPGLSARQLGVMPDLV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP EKQKIIFGNQELFDVKAAIDTKDSQTNSKLFN YFRDKAFPGLSARQLGVMPDLVLDMFINGYYL |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | DFDAEGNLEAIYVTDSDAN ASIGMKKYAVGINAHGKVA ISAKKIEGDNIGAQVLGLF TLSTGQDIWQKLS (SEQ ID NO: 1007) | NLFKTQSTDVNRPYQDKDKRGGIFDAVFTRGV QTTLLTARHDLKNKGLNEISDLIKQELTEGKA LALSHTYANVRINHVINLWGADFDAEGNLEAI YVTDSDANASIGMKKYAVGINAHGKVAISAKK IEGDNIGAQVLGLFTLSTGQDIWQKLS (SEQ ID NO: 1277) |
| VRT-256 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFL WESNGQPENNYKTTPPVLDSDGSFFLYSKLTV DKAFPGLSARQLGVMPDLV LDMFINGYYLNLPKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGNLEAIYVTDSDAN ASIGMKKYAVGINAHGKVA ISAKKIEGDNIGAQVLGLF TLSTGQDIWQKLS (SEQ ID NO: 1008) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALAEKQKIIFGNQELFDVKAAIDTKDSQTNSKLFN LSHTYANVRINHVINLWGAYFLDKAFPGLSARQLGVMPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGNLEAI YVTDSDANASIGMKKYAVGINAHGKVAISAKK IEGDNIGAQVLGLFTLSTGQDIWQKLS (SEQ ID NO: 1278) |
| VRT-257 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFL WESNGQPENNYKTTPPVLDSDGSFFLYSKLTV DKAFPGLSARQLGVMPDLV LDMFINGYYLNLPKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGELEAIYVTDSDAN ASIGMKKYAVGINAHGKVA ISAKKIEGDNIGAQVLGLF TLSTGQDQWQKLS (SEQ ID NO: 1009) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALAEKQKIIFGNQELFDVKAAIDTKDSQTNSKLFN LSHTYANVRINHVINLWGAYFLDKAFPGLSARQLGVMPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGELEAI YVTDSDANASIGMKKYAVGINAHGKVAISAKK IEGDNIGAQVLGLFTLSTGQDQWQKLS (SEQ ID NO: 1279) |
| VRT-258 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFR WESNGQPENNYKTTPPVLDSDGSFFLYSKLTV DKAFPGLSARQLGVPDLV LDMFINGYYLNLPKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DEDAEGNLEAIYVTDSDAN ASIGMKKYAVGINAHGKVA ISAKKIEGDNIGAQVLGLF TLSTGQDIWQKLS (SEQ ID NO: 1010) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALAEKQKIIFGNQELFDVKAAIDTKDSQTNSKLFN LSHTYANVRINHVINLWGAYFRDKAFPGLSARQLGVPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGNLEAI YVTDSDANASIGMKKYAVGINAHGKVAISAKK IEGDNIGAQVLGLFTLSTGQDIWQKLS (SEQ ID NO: 1280) |
| VRT-259 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFNYFL WESNGQPENNYKTTPPVLDSDGSFFLYSKLTV DKAFPGLSARQLGVPDLV LDMFINGYYLNLPKTQSTD VNRPYQDKDKRGGIFDAVF TRGVQTTLLTARHDLKNKG NLLCGAATAGNMLHWWFDQNKEEIERYLKKHP LNEISDLIKQELTEGKALA LSHTYANVRINHVINLWGA DFDAEGNLEAIYVTDSDAN | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP LNEISDLIKQELTEGKALAEKQKIIFGNQELFDVKAAIDTKDSQTNSKLFN LSHTYANVRINHVINLWGAYFLDKAFPGLSARQLGVPDLVLDMFINGYYL NLPKTQSTDVNRPYQDKDKRGGIFDAVFTRGV |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | ASIGMKKYAVGINAHGKVA ISAKKIEGDNIGAQVLGLF TLSTGQDIWQKLS (SEQ ID NO: 1011) | QTTLLLTARHDLKNKGLNEISDLIKQELTEGKA LALSHTYANVRINHVINLWGADFDAEGNLEAI YVTDSDANASIGMKKYAVGINAHGKVAISAKK IEGDNIGAQVLGLFTLSTGQDIWQKLS (SEQ ID NO: 1281) |
| VRT-260 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR ENNEDVLHAPYLANQGWYD ITKAFDGKDNLLCGAATAG NMLHWWFDQNKEEIERYLK KEYKCKVSNKALKAPIEKTISKAKGQPREPQV KHPEKQKIIFGNQELFDVK AAIDTKDSQTNSKLFNYFL DKAFPGLSARQLGVFPDLV LDMFINGYYLNLPKTQSTD VNRPYQDKDKRGGIFDAVF TRGVQTTLLTARHDLKNKG LNEISDLIKQELTEGKALA LSHTYANVRINHVINLWGA DFDAEGELEAIYVTDSDAN ASIGMKKYAVGINAHGKVA ISAKKIEGDNIGAQVLGLF TLSTGQDWQKLS (SEQ ID NO: 1012) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGTITSVWTKGVTPPTP EDFRENNEDVLHAPYLANQGWYDITKAFDGKD NLLCGAATAGNMLHWWFDQNKEEIERYLKKHP EKQKIIFGNQELFDVKAAIDTKDSQTNSKLFN YFLDKAFPGLSARQLGVFPDLVLDMFINGYYL NLPKTQSTDVNRPYQDKDKRGGIFDAVFTRGV QTTLLTARHDLKNKGLNEISDLIKQELTEGKA LALSHTYANVRINHVINLWGADFDAEGELEAI YVTDSDANASIGMKKYAVGINAHGKVAISAKK IEGDNIGAQVLGLFTLSTGQDWQKLS (SEQ ID NO: 1282) |
| VRT-261 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR EYNEDVLHAPYLANQGWYD ITKAFDGKDNLLCGAATAG NMLHWWFDQNKEEIERYLK KEYKCKVSNKALKAPIEKTISKAKGQPREPQV KHPEKQKIIFGNQELFDVK AAIDTKDSQTNSKLFNYFR WESNGQPENNYKTTPPVLDSDGSFFLYSKLTV DKAFPGLSARQLGVFPDLV DKSRWQQGNVFSCSVMHEALHNHYTQKSLSLS LDMFINGYYLNLPKTQSTD PGGGGSGGGGSGGGGSGTITSVWTKGVTPPTP VNRPYQDKDKRGGIFDAVF EDFREYNEDVLHAPYLANQGWYDITKAFDGKD TRGVQTTLLTARHDLKNKG NLLCGAATAGNMLHWWFDQNKEEIERYLKKHP LNEISDLIKQELTEGKALA EKQKIIFGNQELFDVKAAIDTKDSQTNSKLFN LSHTYANVRINHVINLWGA YFRDKAFPGLSARQLGVFPDLVLDMFINGYYL DFDAEGNLEAIYVTDSDTR NLFKTQSTDVNRPYQDKDKRGGIFDAVFTRGV ASIGMKKYAVGINAHGKVA QTTLLTARHDLKNKGLNEISDLIKQELTEGKA ISAKKIEGDNIGAQVLGLF LALSHTYANVRINHVINLWGADFDAEGNLEAI TLSTGQDIWQKLS (SEQ ID NO: 1013) | YVTDSDTRASIGMKKYAVGINAHGKVAISAKK IEGDNIGAQVLGLFTLSTGQDIWQKLS (SEQ ID NO: 1283) |
| VRT-262 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | TITSVWTKGVTPPTPEDFR EYNEDVLHAPYLANQGWYD ITKAFDGKDNLLCGAATAG NMLHWWFDQNKEEIERYLK KEYKCKVSNKALKAPIEKTISKAKGQPREPQV KHPEKQKIIFGNQELFDVK AAIDTKDSQTNSKLFNYFL WESNGQPENNYKTTPPVLDSDGSFFLYSKLTV DKAFPGLSARQLGVFPDLV DKSRWQQGNVFSCSVMHEALHNHYTQKSLSLS LDMFINGYYLNLPKTQSTD PGGGGSGGGGSGGGGSGTITSVWTKGVTPPTP VNRPYQDKDKRGGIFDAVF EDFREYNEDVLHAPYLANQGWYDITKAFDGKD TRGVQTTLLTARHDLKNKG NLLCGAATAGNMLHWWFDQNKEEIERYLKKHP LNEISDLIKQELTEGKALA EKQKIIFGNQELFDVKAAIDTKDSQTNSKLFN LSHTYANVRINHVINLWGA YFLDKAFPGLSARQLGVFPDLVLDMFINGYYL DFDAEGNLEAIYVTDSDTR NLPKTQSTDVNRPYQDKDKRGGIFDAVFTRGV ASIGMKKYAVGINAHGKVA QTTLLTARHDLKNKGLNEISDLIKQELTEGKA ISAKKIEGDNIGAQVLGLF LALSHTYANVRINHVINLWGADFDAEGNLEAI TLSTGQDIWQKLS (SEQ ID NO: 1014) | YVTDSDTRASIGMKKYAVGINAHGKVAISAKK IEGDNIGAQVLGLFTLSTGQDIWQKLS (SEQ ID NO: 1284) |
| VRT-263 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | | TITSVWTKGVTPPTPEDFR EYNEDVLHAPYLANQGWYD ITKAFDGKDNLLCGAATAG NMLHWWFDQNKEEIERYLK KEYKCKVSNKALKAPIEKTISKAKGQPREPQV KHPEKQKIIFGNQELFDVK AAIDTKDSQTNSKLFNYFL WESNGQPENNYKTTPPVLDSDGSFFLYSKLTV DKAFPGLSARQLGVFPDLV DKSRWQQGNVFSCSVMHEALHNHYTQKSLSLS LDMFINGYYLNLPKTQSTD PGGGGSGGGGSGGGGSGTITSVWTKGVTPPTP VNRPYQDKDKRGGIFDAVF EDFREYNEDVLHAPYLANQGWYDITKAFDGKD TRGVQTTLLTARHDLKNKG NLLCGAATAGNMLHWWFDQNKEEIERYLKKHP LNEISDLIKQELTEGKALA EKQKIIFGNQELFDVKAAIDTKDSQTNSKLFN LSHTYANVRINHVINLWGA YFLDKAFPGLSARQLGVFPDLVLDMFINGYYL DFDAEGELEAIYVTDSDTR NLPKTQSTDVNRPYQDKDKRGGIFDAVFTRGV ASIGMKKYAVGINAHGKVA QTTLLTARHDLKNKGLNEISDLIKQELTEGKA | |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | ISAKKIEGDNIGAQVLGLF TLSTGQDQWQKLS (SEQ ID NO: 1015) | LALSHTYANVRINHVINLWGADFDAEGELEAI YVTDSDTRASIGMKKYAVGINAHGKVAISAKK IEGDNIGAQVLGLFTLSTGQDQWQKLS (SEQ ID NO: 1285) |
| VRT-264 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDGQLKLSDFLNTYESDDG YRDKSKLFDFISNNFNGPV WTDKLLDNYINGYAYNSKY GRTIEDSTKNTSKINFFKE VFNEKILTNIHSIRNQNEF SVLLSEALYTGKAIGLSYG PAGLRHSLGHIISVWGADL ISNNFNGPVWTDKLLDNYI NGYAYNSKYGRTIEDSTKN TSKINFFKEVFNEKILTNI HSIRNQNEFSVLLSEALYT GKAIGLSYGPAGLRHSLGH IISVWGADLDADGNVVAIY VTDSDDKKLTIGDERVGLK RYKISTDDEEFSVLLSEAL YTGKAIGLSYGPAGLRHSL GHIISVWGADLDADGNVVA IYVTDSDDKKLTIGDEGRL RLTAYEETHNTGGQVRLWT LDTGKAWADYFDKT EQTGTDQAEQ (SEQ ID NO: 1016) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDNDKCA AVAANMFHYWLDRNRDNVDRFLRQNPEKHGI IELPDGQLKLSDFLNTYESDDGYRDKSKLFDF ISNNFNGPVWTDKLLDNYINGYAYNSKYGRTI EDSTKNTSKINFFKEVFNEKILTNIHSIRNQN EFSVLLSEALYTGKAIGLSYGPAGLRHSLGHI ISVWGADLDADGNVVAIYVTDSDDKKLTIGDE RVGLKRYKISTDDEGRLRLTAYEETHNTGGQV RLWTLDTGKAWADYFDKTEQTGTDQAEQ (SEQ ID NO: 1286) |
| VRT-265 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDGQLKLSDFLNTYESDDG YRDKSKLFDFISENENGPV WTDKLLDNYINGYAYNSKY GRTIEDSTKNTSKINFFKE VFNEKILTNIHSIRNQNEF SVLLIEALYTGKAIGLSYG PAGLRHGLGHIISVWGADL ISENFNGPVWTDKLLDNYI NGYAYNSKYGRTIEDSTKN TSKINFFKEVFNEKILTNI HSIRNQNEFSVLLIEALYT GKAIGLSYGPAGLRHGLGH IISVWGADLDADGNVVAIY VTDSDDKKLTIGDERVGLK RYKISTDDE GRLRLTAYEETHNTGGQVR LWTLDTGKAWADYFDKT EQTGTDQAEQ (SEQ ID NO: 1017) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDNDKCA AVAANMFHYWLDRNRDNVDRFLRQNPEKHGI IELPDGQLKLSDFLNTYESDDGYRDKSKLFDF ISENFNGPVWTDKLLDNYINGYAYNSKYGRTI EDSTKNTSKINFFKEVFNEKILTNIHSIRNQN EFSVLLIEALYTGKAIGLSYGPAGLRHGLGHI ISVWGADLDADGNVVAIYVTDSDDKKLTIGDE RVGLKRYKISTDDEGRLRLTAYEETHNTGGQV RLWTLDTGKAWADYFDKTEQTGTDQAEQ (SEQ ID NO: 1287) |
| VRT-266 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDEQLKLSDFLNTYESDDG YRDKSKLFDFISNNFNKPV WTDKLLDNYINGYAYNSKY GRTIEDSTKNTSKINFFKE VFNEKILTNIHSIRNQNEF SVLLSEALYTGKAIGLSYG PAGLRHSLGHIISVWGADL ISNNFNKPVWTDKLLDNYINGYAYNSKYGRTI EDSTKNTSKINFFKEVFNEKILTNIHSIRNQN EFSVLLSEALYTGKAIGLSYGPAGLRHSLGHI ISVWGADLDADGNVVAIYVTDSDDKKLTIGDE RVGLKRYKISTDDE GRLRLTAYEETHNTGGQVR LWTLDTGKAWADYFDKT EQTGTDQAEQ (SEQ ID NO: 1018) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDNDKCA AVAANMFHYWLDRNRDNVDRFLRQNPEKHGI IELPDEQLKLSDFLNTYESDDGYRDKSKLFDF ISNNFNKPVWTDKLLDNYINGYAYNSKYGRTI EDSTKNTSKINFFKEVFNEKILTNIHSIRNQN EFSVLLSEALYTGKAIGLSYGPAGLRHSLGHI ISVWGADLDADGNVVAIYVTDSDDKKLTIGDE RVGLKRYKISTDDEGRLRLTAYEETHNTGGQV RLWTLDTGKAWADYFDKTEQTGTDQAEQ (SEQ ID NO: 1288) |
| VRT-267 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGGSGG GGSGGGG SG (SEQ ID NO: 1020) | SQTEDSESLQRLRDIEDFQ AEKKKQNVVYTKWLDGVDV KDHDFRKIVDGNSAYYATP LLNGRGFYDINKDFNRDND KCAAAVAANMFHYWLDRNR DNVDRFLRQNPEKHGIIEL PDEQLKLSDFLNTYESDDG YRDKSKLFDFISENENKPV WTDKLLDNYINGYAYNSKY GRTIEDSTKNTSKINFFKE VFNEKILTNIHSIRNQNEF SVLLIEALYTGKAIGLSYG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSGGGGSGGGGSGSQTEDSESLQRLRDI EDFQAEKKKQNVVYTKWLDGVDVKDHDFRKIV DGNSAYYATPLLNGRGFYDINKDFNRDNDKCA AVAANMFHYWLDRNRDNVDRFLRQNPEKHGI IELPDEQLKLSDFLNTYESDDGYRDKSKLFDF |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | PAGLRHGLGHIISVWGADL DADGNVVAIYVTDSDDKKL TIGDERVGLKRYKISTDDE EFSVLLIEALYTGKAIGLSYGPAGLRHGLGHII GRLRLTAYEETHNTGGQVR GLWTLDTGKQAWADYFDKT EQTGTDQAEQ (SEQ ID NO: 1019) | ISENFNKPVWTDKLLDNYINGYAYNSKYGRTI EDSTKNTSKINFFKEVFNEKILTNIHSIRNQN TIGDERVGLKRYKISTDDEGRLRLTAYEETHNTGGQV RVGLKRYKISTDDEGRLRLTAYEETHNTGGQV RGLWTLDTGKQAWADYFDKTEQTGTDQAEQ (SEQ ID NO: 1289) |
| VRT-268 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFNGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRINHVINLWGADFDAEG NLEAIYVTDSDSNPSIGMK KYFVGVNSSGKVAISAKEI EEDNIGAQVLGLFTLSTGQ DIWNQTN (SEQ ID NO: 1291) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA KLLTNRYDLKEKTLKEISDGNMLHWWFDQNKEQIKNYLKKYPEKQKINFGG LIKQELTEGKALGISHTYA EQLFDVKEAIDTKDSQLDSKLFDYFKEKAFPY NVRINHVINLWGADFDAEG LSTKHLGVFPDHVIDMFINGYRLSLTDHGPTP NLEAIYVTDSDSNPSIGMK VKRGSKDPRGGIFDAVFTRGDQSKLLTNRYDL KYFVGVNSSGKVAISAKEI KEKTLKEISDLIKQELTEGKALGISHTYANVR EEDNIGAQVLGLFTLSTGQ INHVINLWGADFDAEGNLEAIYVTDSDSNPSI DIWNQTN (SEQ ID NO: GMKKYFVGVNSSGKVAISAKEIEEDNIGAQVL GLFTLSTGQDIWNQTN (SEQ ID NO: 1311) |
| VRT-269 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFGGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD GNMLHWWFDQNKEQIKNYLKKYPEKQKINFGG LIKQELTEGKALGISHTYA NVRINHVINLWGADFDAEG NLEAIYVTDSDSNPSIGMK KYFVGVNSSGKVAISAKEI EEDNIGAQVLGLFTLSTGQ DIWNQTN (SEQ ID NO: 1292) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIKNYLKKYPEKQKINFGG LIKQELTEGKALGISHTYA EQLFDVKEAIDTKDSQLDSKLFDYFKEKAFPY NVRINHVINLWGADFDAEG LSTKHLGVFPDHVIDMFINGYRLSLTDHGPTP NLEAIYVTDSDSNPSIGMK VKRGSKDPRGGIFDAVFTRGDQSKLLINRYDL KYFVGVNSSGKVAISAKEI KEKTLKEISDLIKQELTEGKALGISHTYANVR EEDNIGAQVLGLFTLSTGQ INHVINLWGADFDAEGNLEAIYVTDSDSNPSI DIWNQTN (SEQ ID NO: GMKKYFVGVNSSGKVAISAKEIEEDNIGAQVL GLFTLSTGQDIWNQTN (SEQ ID NO: 1312) |
| VRT-270 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFNGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD GNMLHWWFDQNKEQIENYLKKYPEKQKINENG LIKQELTEGKALGISHTYA NVRINHVINLWGADFDAEG NLEAIYVINSDSNPSIGMK KYFVGVNSSGKVAISAKEI EEDNIGAQVLGLFTLSTGQ DIWQQTN (SEQ ID NO: 1300) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINENG LIKQELTEGKALGISHTYA EQLFDVKEAIDTKDSQLDSKLFDYFKEKAFPY NVRINHVINLWGADFDAEG LSTKHLGVFPDHVIDMFINGYRLSLTDHGPTP NLEAIYVINSDSNPSIGMK VKRGSKDPRGGIFDAVFTRGDQSKLLTNRYDL KYFVGVNSSGKVAISAKEI KEKTLKEISDLIKQELTEGKALGISHTYANVR EEDNIGAQVLGLFTLSTGQ INHVINLWGADFDAEGNLEAIYVINSDSNPSI DIWQQTN (SEQ ID NO: GMKKYFVGVNSSGKVAISAKEIEEDNIGAQVL GLFTLSTGQDIWQQTN (SEQ ID NO: 1313) |
| VRT-271 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFNGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD GNMLHWWFDQNKEQIENYLKKYPEKQKINENG LIKQELTEGKALGISHTYA NVRINHVINLWGADFDAEG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINENG LIKQELTEGKALGISHTYA EQLFDVKEAIDTKDSQLDSKLFDYFKEKAFPY NVRINHVINLWGADFDAEG LSTKHLGVFPDHVIDMFINGYRLSLTDHGPTP |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | NLEAIYVTDSNSNPSIGMK KYFVGVNSSGKVAISAKEI EEDNIGAQVLGLFTLSTGQ DIWQQTN (SEQ ID NO: 1301) | VKRGSKDPRGGIFDAVFTRGDQSKLLTNRYDL KEKTLKEISDLIKQELTEGKALGISHTYANVR INHVINLWGADFDAEGNLEAIYVTDSNSNPSI GMKKYFVGVNSSGKVAISAKEIEEDNIGAQVL GLFTLSTGQDIWQQTN (SEQ ID NO: 1314) |
| VRT-272 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF DKSRWQQGNVFSCSVMHEA INGYRLSLTDHGPTPVKRG SKDPRGGIFDAVFTRGDQS KLLTNRYDLKEKTLKEISD LIKQELTEGKALGISHTYA NVRINHVINLWGADFDAEG NLEAIYVINSDSNPSIGMK KYFVGVNSSGKVAISAKEI EEDNIGAQVLGLFTLSTGQ DIWQQTN (SEQ ID NO: 1293) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV KQKINFKGEQLFDVKEAID YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG LIKQELTEGKALGISHTYA EQLFDVKEAIDTKDSQLDSKLFDYFKEKAFPY NVRINHVINLWGADFDAEG LSTKHLGVFPDHVIDMFINGYRLSLTDHGPTP NLEAIYVINSDSNPSIGMK VKRGSKDPRGGIFDAVFTRGDQSKLLTNRYDL KYFVGVNSSGKVAISAKEI KEKTLKEISDLIKQELTEGKALGISHTYANVR EEDNIGAQVLGLFTLSTGQ INHVINLWGADFDAEGNLEAIYVINSDSNPSI GMKKYFVGVNSSGKVAISAKEIEEDNIGAQVL GLFTLSTGQDIWQQTN (SEQ ID NO: 1315) |
| VRT-273 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRINHVINLWGADFDAEG NLEAIYVTDSNSNPSIGMK KYFVGVNSSGKVAISAKEI EEDNIGAQVLGLFTLSTGQ DIWQQTN (SEQ ID NO: 1294) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP NLEAIYVTDSNSNPSIGMK VKRGSKDPRGGIFDAVFTRGDQSKLLTNRYDL KYFVGVNSSGKVAISAKEI KEKTLKEISDLIKQELTEGKALGISHTYANVR EEDNIGAQVLGLFTLSTGQ INHVINLWGADFDAEGNLEAIYVTDSNSNPSI GMKKYFVGVNSSGKVAISAKEIEEDNIGAQVL GLFTLSTGQDIWQQTN (SEQ ID NO: 1316) |
| VRT-274 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFNGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA EQLFDVKEAIDTKDSQLDSKLFDYFKEKAFPY NVRIGHVINLWGADFDAEG LSTKHLGVFPDHVIDMFINGYRLSLTDHGPTP NLEAIYVTDSDSNPSIGMK VKRGSKDPRGGIFDAVFTRGDQSKLLINRYDL KYFVGVNSSGKVAISAKEI KEKTLKEISDLIKQELTEGKALGISHTYANVR EEDNIGAQVLGLFTLSTGQ IGHVINLWGADFDAEGNLEAIYVTDSDSNPSI DIWQTN (SEQ ID NO: 1302) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIKNYLKKYPEKQKINFNG GMKKYFVGVNSSGKVAISAKEIEEDNIGAQVL GLFTLSTGQDIWQTN (SEQ ID NO: 1317) |
| VRT-275 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFGGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD GNMLHWWFDQNKEQIKNYLKKYPEKQKINFGG LIKQELTEGKALGISHTYA EQLFDVKEAIDTKDSQLDSKLFDYFKEKAFPY NVRIGHVINLWGADFDAEG LSTKHLGVFPDHVIDMFINGYRLSLTDHGPTP NLEAIYVTDSDSNPSIGMK VKRGSKDPRGGIFDAVFTRGDQSKLLTNRYDL | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA |

TABLE 8-continued

| ID | N-terminus Fc Moiety | Linker | C-terminus Protease Moiety | Full length Sequence |
|---|---|---|---|---|
| | SFFLYSKLTVDKSR WQQGNVFSCSVMHE ALHNHYTQKSLSLS PG (SEQ ID NO: 23) | | KYFVGVNSSGKVAISAKEI EEDNIGAQVLGLFTLSTGQ DIWNQTN (SEQ ID NO: 1303) | KEKTLKEISDLIKQELTEGKALGISHTYANVR IGHVINLWGADFDAEGNLEAIYVTDSDSNPSI GMKKYFVGVNSSGKVAISAKEIEEDNIGAQVL GLFTLSTGQDIWNQTN (SEQ ID NO: 1318) |
| VRT-276 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFNGEQLEDVKEAID TKDSQLDSKLFDYFKEKAF PYLSTKHLGVFPDHVIDMF INGYRLSLTDHGPTPVKRG PGGGGSKGGGSKVTSVWTK GVTPPTDFIYGEDVLHAPY KAGQGWYDITKLFNGKDDL LCGAATAKLLTNRYDLKEKTLKEISD GNMLHWWFDQNKEQIENYLKKYPEKQKINENG LIKQELTEGKALGISHTYA EQLFDVKEAIDTKDSQLDSKLFDYFKEKAFPY NVRIGHVINLWGADFDAEG LSTKHLGVFPDHVIDMFINGYRLSLTDHGPTP NLEAIYVTNSDSNPSIGMK VKRGSKDPRGGIFDAVFTRGDQSKLLTNRYDL KYFVGVNSSGKVAISAKEI KEKTLKEISDLIKQELTEGKALGISHTYANVR EEDNIGAQVLGLFTLSTGQ IGHVINLWGADFDAEGNLEAIYVINSDSNPSI DIWQQTN (SEQ ID NO: 1304) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA KLLTNRYDLKEKTLKEISDGNMLHWWFDQNKEQIENYLKKYPEKQKINENG LIKQELTEGKALGISHTYAEQLFDVKEAIDTKDSQLDSKLFDYFKEKAFPY NVRIGHVINLWGADFDAEGLSTKHLGVFPDHVIDMFINGYRLSLTDHGPTP NLEAIYVTNSDSNPSIGMKVKRGSKDPRGGIFDAVFTRGDQSKLLTNRYDL KYFVGVNSSGKVAISAKEIKEKTLKEISDLIKQELTEGKALGISHTYANVR EEDNIGAQVLGLFTLSTGQIGHVINLWGADFDAEGNLEAIYVINSDSNPSI GMKKYFVGVNSSGKVAISAKEIEEDNIGAQVL GLFTLSTGQDIWQQTN (SEQ ID NO: 1319) |
| VRT-277 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFNGEQLFDVKEAID TKDSQLDSKLFDYFKEKAF PYLSTKHLGVFPDHVIDMF DKSRWQQGNVFSCSVMHEALHNHYTQKSLSLS INGYRLSLTDHGPTPVKRG PGGGGSKGGGSKVTSVWTKGVTPPTDFIYGED SKDPRGGIFDAVFTRGDQS VLHAPYKAGQGWYDITKLFNGKDDLLCGAATA KLLINRYDLKEKTLKEISD GNMLHWWFDQNKEQIENYLKKYPEKQKINFKG LIKQELTEGKALGISHTYA EQLFDVKEAIDTKDSQLDSKLFDYFKEKAFPY NVRIGHVINLWGADFDAEG LSTKHLGVFPDHVIDMFINGYRLSLTDHGPTP NLEAIYVTDSNSNPSIGMK VKRGSKDPRGGIFDAVFTRGDQSKLLINRYDL KYFVGVNSSGKVAISAKEI KEKTLKEISDLIKQELTEGKALGISHTYANVR EEDNIGAQVLGLFTLSTGQ IGHVINLWGADFDAEGNLEAIYVTDSNSNPSI DIWQQTN (SEQ ID NO: 1305) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV GMKKYFVGVNSSGKVAISAKEIEEDNIGAQVL GLFTLSTGQDIWQQTN (SEQ ID NO: 1320) |
| VRT-278 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRIGHVINLWGADFDAEG NLEAIYVINSDSNPSIGMK KYFVGVNSSGKVAISAKEI EEDNIGAQVLGLFTLSTGQ DIWQQTN (SEQ ID NO: 1306) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA KLLTNRYDLKEKTLKEISDGNMLHWWFDQNKEQIENYLKKYPEKQKINFKG LIKQELTEGKALGISHTYAEQLFDVKEAIDTKDSQLDSKLFDYFKEKAFPY NVRIGHVINLWGADFDAEGLSTKHLGVFPDHVIDMFINGYRLSLTDHGPTP NLEAIYVINSDSNPSIGMKVKRGSKDPRGGIFDAVFTRGDQSKLLINRYDL KYFVGVNSSGKVAISAKEIKEKTLKEISDLIKQELTEGKALGISHTYANVR EEDNIGAQVLGLFTLSTGQIGHVINLWGADFDAEGNLEAIYVINSDSNPSI GMKKYFVGVNSSGKVAISAKEIEEDNIGAQVL GLFTLSTGQDIWQQTN (SEQ ID NO: 1321) |
| VRT-279 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRIGHVINLWGADFDAEG NLEAIYVTDSNSNPSIGMK KYFVGVNSSGKVAISAKEI | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLENGKDDLLCGAATA KLLTNRYDLKEKTLKEISD GNMLHWWFDQNKEQIENYLKKYPEKQKINFKG LIKQELTEGKALGISHTYA EQLFDVKEAIDTKDSQLDSKLFDYFKEKAFPY NVRIGHVINLWGADFDAEG LSTKHLGVFPDHVIDMFINGYRLSLTDHGPTP NLEAIYVTDSNSNPSIGMK VKRGSKDPRGGIFDAVFTRGDQSKLLINRYDL KYFVGVNSSGKVAISAKEI KEKTLKEISDLIKQELTEGKALGISHTYANVR |

TABLE 8-continued

| ID | N-terminus Fc Moiety | Linker | C-terminus Protease Moiety | Full length Sequence |
|---|---|---|---|---|
| | WQQGNVFSCSVMHE ALHNHYTQKSLSLS PG (SEQ ID NO: 23) | | EEDNIGAQVLGLFTLSTGQ DIWQQTN (SEQ ID NO: 1307) | IGHVINLWGADFDAEGNLEAIYVTDSNSNPSI GMKKYFVGVNSSGKVAISAKEIEEDNIGAQVL GLFTLSTGQDIWQQTN (SEQ ID NO: 1322) |
| VRT-280 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFGGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA EQLFDVKEAIDTKDSQLDSKLFDYFKEKAFPY NGRINHVINLWGADFDAEG LSTKHLGVFPDHVIDMFINGYRLSLTDHGPTP NLEAIYVTDSDSNPSIGMK VKRGSKDPRGGIFDAVFTRGDQSKLLTNRYDL KYFVGVNSSGKVAISAKEI KEKTLKEISDLIKQELTEGKALGISHTYANGR EEDNIGAQVLGLFTLSTGQ INHVINLWGADFDAEGNLEAIYVTDSDSNPSI DIWQQTN (SEQ ID NO: 1296) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIKNYLKKYPEKQKINENG GMKKYFVGVNSSGKVAISAKEIEEDNIGAQVL GLFTLSTGQDIWQQTN (SEQ ID NO: 1323) |
| VRT-281 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIKNYLKKYPE KQKINFGGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVTDSDSNPSIGMK KYFVGVNSSGKVAISAKEI EEDNIGAQVLGLFTLSTGQ DIWNQTN (SEQ ID NO: 1297) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIKNYLKKYPEKQKINFGG EQLFDVKEAIDTKDSQLDSKLFDYFKEKAFPY NGRINHVINLWGADFDAEG LSTKHLGVFPDHVIDMFINGYRLSLTDHGPTP NLEAIYVTDSDSNPSIGMK VKRGSKDPRGGIFDAVFTRGDQSKLLTNRYDL KYFVGVNSSGKVAISAKEI KEKTLKEISDLIKQELTEGKALGISHTYANGR EEDNIGAQVLGLFTLSTGQ INHVINLWGADFDAEGNLEAIYVTDSDSNPSI GMKKYFVGVNSSGKVAISAKEIEEDNIGAQVL GLFTLSTGQDIWNQTN (SEQ ID NO: 1324) |
| VRT-282 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVINSDSNPSIGMK KYFVGVNSSGKVAISAKEI EEDNIGAQVLGLFTLSTGQ DIWQQTN (SEQ ID NO: 1308) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINENG EQLFDVKEAIDTKDSQLDSKLFDYFKEKAFPY NGRINHVINLWGADFDAEGLSTKHLGVFPDHVIDMFINGYRLSLTDHGPTP NLEAIYVINSDSNPSIGMK VKRGSKDPRGGIFDAVFTRGDQSKLLINRYDL KYFVGVNSSGKVAISAKEI KEKTLKEISDLIKQELTEGKALGISHTYANGR EEDNIGAQVLGLFTLSTGQ INHVINLWGADFDAEGNLEAIYVINSDSNPSI GMKKYFVGVNSSGKVAISAKEIEEDNIGAQVL GLFTLSTGQDIWQQTN (SEQ ID NO: 1325) |
| VRT-283 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFGEQLEDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVTDSNSNPSIGMK KYFVGVNSSGKVAISAKEI EEDNIGAQVLGLFTLSTGQ | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINENG EQLFDVKEAIDTKDSQLDSKLFDYFKEKAFPY NGRINHVINLWGADFDAEG LSTKHLGVFPDHVIDMFINGYRLSLTDHGPTP NLEAIYVTDSNSNPSIGMK VKRGSKDPRGGIFDAVFTRGDQSKLLTNRYDL KYFVGVNSSGKVAISAKEI KEKTLKEISDLIKQELTEGKALGISHTYANGR EEDNIGAQVLGLFTLSTGQ INHVINLWGADFDAEGNLEAIYVTDSNSNPSI |

TABLE 8-continued

| ID | N-terminus Fc Moiety | Linker | C-terminus Protease Moiety | Full length Sequence |
|---|---|---|---|---|
| | ALHNHYTQKSLSLS PG (SEQ ID NO: 23) | | DIWQQTN (SEQ ID NO: 1309) | GMKKYFVGVNSSGKVAISAKEIEEDNIGAQVL GLFTLSTGQDIWQQTN (SEQ ID NO: 1326) |
| VRT-284 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVTNSDSNPSIGMK KYFVGVNSSGKVAISAKEI EEDNIGAQVLGLFTLSTGQ DIWQQTN (SEQ ID NO: 1298) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP VKRGSKDPRGGIFDAVFTRGDQSKLLTNRYDL KEKTLKEISDLIKQELTEGKALGISHTYANGR INHVINLWGADFDAEGNLEAIYVINSDSNPSI GMKKYFVGVNSSGKVAISAKEIEEDNIGAQVL GLFTLSTGQDIWQQTN (SEQ ID NO: 1327) |
| VRT-285 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVTDSNSNPSIGMK KYFVGVNSSGKVAISAKEI EEDNIGAQVLGLFTLSTGQ DIWQQTN (SEQ ID NO: 1299) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP VKRGSKDPRGGIFDAVFTRGDQSKLLINRYDL KEKTLKEISDLIKQELTEGKALGISHTYANGR INHVINLWGADFDAEGNLEAIYVTDSNSNPSI GMKKYFVGVNSSGKVAISAKEIEEDNIGAQVL GLFTLSTGQDIWQQTN (SEQ ID NO: 1328) |
| VRT-286 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRIGHVINLWGADFDAEG NLEAIYVTDSDSNPSIGMK KYFVGVNSSGKVAISAKEI EEDNIGAQVLGLFTLSTGQ DIWQQTN (SEQ ID NO: 1310) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP VKRGSKDPRGGIFDAVFTRGDQSKLLINRYDL KEKTLKEISDLIKQELTEGKALGISHTYANVR IGHVINLWGADFDAEGNLEAIYVTDSDSNPSI GMKKYFVGVNSSGKVAISAKEIEEDNIGAQVL GLFTLSTGQDIWQQTN (SEQ ID NO: 1329) |
| VRT-317 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NVRINHVINLWGADFDAEG | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP |

TABLE 8-continued

| ID | N-terminus Fc Moiety | Linker | C-terminus Protease Moiety | Full length Sequence |
|---|---|---|---|---|
| | NNYKTTPPVLDSDG SFFLYSKLTVDKSR WQQGNVFSCSVMHE ALHNHYTQKSLSLS PG (SEQ ID NO: 23) | | NLEAIYVTDSDSNPSIGMK KYFVGVNSSGKVAISAKEI EEDNIGAQVLGLFTLSTGQ DIWQQTN (SEQ ID NO: 1290) | VKRGSKDPRGGIFDAVFTRGDQSKLLTNRYDL KEKTLKEISDLIKQELTEGKALGISHTYANVR INHVINLWGADFDAEGNLEAIYVTDSDSNPSI GMKKYFVGVNSSGKVAISAKEIEEDNIGAQVL GLFTLSTGQDIWQQTN (SEQ ID NO: 1334) |
| VRT-318 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | VTSVWTKGVTPPTDFIYGE DVLHAPYKAGQGWYDITKL FNGKDDLLCGAATAGNMLH WWFDQNKEQIENYLKKYPE KQKINFKGEQLFDVKEAID TKDSQLDSKLFDYFKEKAF PYLSTKHLGVFPDHVIDMF INGYRLSLTDHGPTPVKRG SKDPRGGIFDAVFTRGDQS KLLTNRYDLKEKTLKEISD LIKQELTEGKALGISHTYA NGRINHVINLWGADFDAEG NLEAIYVTDSDSNPSIGMK KYFVGVNSSGKVAISAKEI EEDNIGAQVLGLFTLSTGQ DIWQQTN (SEQ ID NO: 1295) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKVTSVWTKGVTPPTDFIYGED VLHAPYKAGQGWYDITKLFNGKDDLLCGAATA GNMLHWWFDQNKEQIENYLKKYPEKQKINFKG EQLFDVKEAIDTKDSQLDSKLFDYFKEKAFPY LSTKHLGVFPDHVIDMFINGYRLSLTDHGPTP VKRGSKDPRGGIFDAVFTRGDQSKLLTNRYDL KEKTLKEISDLIKQELTEGKALGISHTYANGR INHVINLWGADFDAEGNLEAIYVTDSDSNPSI GMKKYFVGVNSSGKVAISAKEIEEDNIGAQVL GLFTLSTGQDIWQQTN (SEQ ID NO: 1335) |
| VRT-319 | DKTHTCPPCPAPEA AGAPSVFLFPPKPK DTLMISRTPEVTCV VVDVSHEDPEVKFN WYVDGVEVHNAKTK PREEQQNSTYRVVS VLTVLHQDWLNGKE YKCKVSNKALKAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PG (SEQ ID NO: 23) | GGGSKGG GSK (SEQ ID NO: 1330) | TITSVWTKGVTPPTPEDFR ENNEDVLHAPYLANQGWYD ITKAFDGKDNLLCGAATAG NMLHWWFDQNKEEIERYLK KHPEKQKIIFGNQELFDVK AAIDTKDSQTNSKLFDYFR DKAFPNLSARQLGVFPDLV LDMFINGYYLNGGKTQSTD VNRPYQDKDKRGGIFDAVF TRGDQTTLLLTARHDLKNKG LNEISDLIKQELTEGKALA LSHTYANVRINHVINLWGA DFDAEGNLEAIYVTDSDAN PSIGMKKYFVGVNAHGKVA ISAKKIEGDNIGAQVLGLF TLSTGQDQWQKLS (SEQ ID NO: 1333) | DKTHTCPPCPAPEAAGAPSVFLFPPKPKDTLM ISRTPEVTCVVVDVSHEDPEVKFNWYVDGVEV HNAKTKPREEQQNSTYRVVSVLTVLHQDWLNG KEYKCKVSNKALKAPIEKTISKAKGQPREPQV YTLPPSRDELTKNQVSLTCLVKGFYPSDIAVE WESNGQPENNYKTTPPVLDSDGSFFLYSKLTV DKSRWQQGNVFSCSVMHEALHNHYTQKSLSLS PGGGGSKGGGSKTITSVWTKGVTPPTPEDFRE NNEDVLHAPYLANQGWYDITKAFDGKDNLLCG AATAGNMLHWWFDQNKEEIERYLKKHPEKQKI IFGNQELFDVKAAIDTKDSQTNSKLFDYFRDK AFPNLSARQLGVFPDLVLDMFINGYYLNGGKT QSTDVNRPYQDKDKRGGIFDAVFTRGDQTTLL TARHDLKNKGLNEISDLIKQELTEGKALALSH TYANVRINHVINLWGADFDAEGNLEAIYVTDS DANPSIGMKKYFVGVNAHGKVAISAKKIEGDN IGAQVLGLFTLSTGQDQWQKLS (SEQ ID NO: 1336) |

TABLE 9

| ID | N-terminus Ides | Fc | C-terminus His-tag |
|---|---|---|---|
| VRT-287 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 26) | DKTHTCPPCPAPEAAGAPSVEL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | HHHHHHHH (SEQ ID NO: 27) |
| VRT-288 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLINHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 26) | DKTHTCPPCPAPEAAGAPSVEL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPG (SEQ ID NO: 24) | HHHHHHHH (SEQ ID NO: 27) |

TABLE 9-continued

| ID | N-terminus Ides | Fc | C-terminus His-tag |
|---|---|---|---|
| VRT-289 | ANQEIRYSEVTPYHVTSVWTKNVTPPAQFT QGEDVFHAPYVANQGWYDITKTFNGKDDLL CGAATAGNMLHWWFDQNKDQIKRYLEEHPE KQKINFNGSQMFDVKEAIDTKNHQLDSKLF EYFKEKAFPYLSTKHLGVFPDHVIDMFING YRLSLNNSGPTPVKNGSKDPRGGIFDAVFT RGDQSKLLTSRHDFKNKSLKEISDLIKKEL TEGKALGLSHTYANVRINHVINLWGADFDS NGTLKAIYVTDSDSNASIGMKKYFVGVNNA TKVAISAKEIKENNTGAQVLGLFTLSTGQD SWNQTN (SEQ ID NO: 28) | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | HHHHHHHH (SEQ ID NO: 27) |
| VRT-290 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADEDS NGNLKAIYVTDSDSNAQIGMKKYFVGVNSA GKVAISAKEIKEDNIGAQVLGLFTLSTGQD SWNQTN (SEQ ID NO: 29) | DKTHTCPPCPAPEAAGAPSVEL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | HHHHHHHH (SEQ ID NO: 27) |
| VRT-291 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 26) | DKTHTCPPCPAPEAAGAPSVFL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | (N/A) |
| VRT-292 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 26) | DKTHTCPPCPAPEAAGAPSVEL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPG (SEQ ID NO: 24) | (N/A) |
| VRT-293 | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLINHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNAQIGMKKYFVGVNSA GKVAISAKEIKEDNIGAQVLGLFTLSTGQD SWNQTN (SEQ ID NO: 29) | DKTHTCPPCPAPEAAGAPSVFL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | (N/A) |
| VRT-294 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLINHGPTPVKEGSKDPRGGIFDAVET RGDQSKLLTSRHDFKEKNLKEISDLIKKEL TEGKALGLSHTYANVRINHVINLWGADFDS | DKTHTSPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP | (N/A) |

TABLE 9-continued

| ID | N-terminus Ides | Fc | C-terminus His-tag |
|---|---|---|---|
| | NGNLKAIYVTDSDSNASIGMKKYFVGVNSA GKVAISAKEIKEDNIGAQVLGLFTLSTGQD SWNQTN (SEQ ID NO: 36) | VLDSDGSFFLYSKLTVDKSRWQ QGNVFSCSVMHEALHNHYTQKS LSLSPGK (SEQ ID NO: 42) | |
| VRT-295 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 36) | DKTHTSPPSPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 43) | (N/A) |
| VRT-296 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 36) | DKTHTCPPCPAPELLGDSGVFL FPPKPKDTLMISRTPEVTCVVV DVSHDEPEVKFNWYVDGVEVHN AKTKPREEQYNSTYRVVSVLTV LHQDWLNGKEYKCKVSNKALPR PIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 44) | (N/A) |
| VRT-297 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 36) | DKTHTCPPCPAPEFEGGPSVFL FPPKPKDTLMISRTPEVTCVVV DVSDEDGEVKFNWYVDGVEVHN AKTKPREEQYNSTYRVVSVLTV LHQDWLNGKEYKCKVSNKALAA PIEKTISKAKGQPREPQVYTLP PSRDELTKNQVSLSCAVKGFYP SDIAVEWESNGQPENNYKTTPP VLDSDGSFFLVSKLTVDKSRWQ QGNVFSCSVMHEALHNHYTQKS LSLSPGK (SEQ ID NO: 45) | (N/A) |
| VRT-298 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 36) | DKTHTCPPCPAPEFEGGPSVFL FPPKPKDTLMISRTPEVTCVVV DVSQEDPEVQFNWYVDGVEVHN AKTKPREEQFNSTYRVVSVLTV LHQDWLNGKEYKCKVSNKALPS SIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 46 | (N/A) |
| VRT-299 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 36) | DKTHTCPPCPAPEFEGGPSVFL FPPKPKDTLMISRTPEVTCVVV DVSDEDGEVQFNWYVDGVEVHN AKTKPREEQFNSTYRVVSVLTV LHQDWLNGKEYKCKVSNKALAS SIEKTISKAKGQPREPQVYTLP PSRDELTKNQVSLSCAVKGFYP SDIAVEWESNGQPENNYKTTPP VLDSDGSFFLVSKLTVDKSRWQ QGNVFSCSVMHEALHNHYTQKS LSLSPGK (SEQ ID NO: 47 | (N/A) |
| VRT-300 | RNATEAYAKEVPHQITSVWTKGVTPLTPEQ FRYNNEDVIHAPYLAHQGWYDITKAFDGKD NLLCGAATAGNMLHWWFDQNKTEIEAYLSK HPEKQKIIFNNQELFDLKAAIDTKDSQTNS QLFNYFRDKAFPNLSARQLGVMPDLVLDMF INGYYLNVFKTQSTDVNRPYQDKDKRGGIF DAVFTRGDQTTLLTARHDLKNKGLNDISTI | DKTHTSPPCPAPEAAGAPSVFL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLTCLVKGFYP | (N/A) |

TABLE 9-continued

| ID | N-terminus IdeS | Fc | C-terminus His-tag |
|---|---|---|---|
| | IKQELTEGRALALSHTYANVSISHVINLWG ADFNAEGNLEAIYVIDSDANASIGMKKYFV GINAHGHVAISAKKIEGENIGAQVLGLFTL SSGKDIWQKLS (SEQ ID NO: 52) | SDIAVEWESNGQPENNYKTTPP VLDSDGSFFLYSKLTVDKSRWQ QGNVFSCSVMHEALHNHYTQKS LSLSPGK (SEQ ID NO: 42) | |
| VRT-301 | ANQEIRYSNVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 50) | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 19) | (N/A) |
| VRT-302 | ANQEIRYSEVTPYHNTSVWTKGVTPPANFT QGEDVFHAPYVANQGWYDITKTENGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADEDS NGSLKAIYVTDSDSNASIGMKKYFVGVNSA GKVAISAKEIKEDNIGAQVLGLFTLSTGQD SWNQTN (SEQ ID NO: 51) | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 19) | (N/A) |
| VRT-303 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLINHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 36) | DKTHTSPPCPAPEAAGAPSVFL FPPKPKDTLMISRTPEVTCVVV DVSHEDPEVKFNWYVDGVEVHN AKTKPREEQYNSTYRVVSVLTV LHQDWLNGKEYKCKVSNKALPA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 48) | (N/A) |
| VRT-304 | ANQEIRYSEVTPYHVTSVWTKGVTPPANFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 36) | DKTHTSPPCPAPELLGGPSVFL FPPKPKDTLMISRTPEVTCVVV DVSHEDPEVKFNWYVDGVEVHN AKTKPREEQYNSTYRVVSVLTV LHQDWLNGKEYKCKVSNKALPA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPGK (SEQ ID NO: 49) | (N/A) |

TABLE 10

| ID | Fc | C-terminus IdeS | C-terminus His-tag |
|---|---|---|---|
| VRT-305 | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 26) | HHHHHHHH (SEQ ID NO: 27) |

TABLE 10-continued

| ID | Fc | C-terminus IdeS | C-terminus His-tag |
|---|---|---|---|
| VRT-306 | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPG (SEQ ID NO: 24) | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 26) | HHHHHHHH (SEQ ID NO: 27) |
| VRT-307 | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADFDS NGNLKAIYVTDSDSNAQIGMKKYFVGVNSA GKVAISAKEIKEDNIGAQVLGLFTLSTGQD SWNQTN (SEQ ID NO: 29) | HHHHHHHH (SEQ ID NO: 27) |
| VRT-308 | DKTHTCPPCPAPEAAGAPSVEL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVET RGDQSKLLTSRHDFKEKNLKEISDLIKKEL TEGKALGLSHTYANVRINHVINLWGADEDS NGNLKAIYVTDSDSNASIGMKKYFVGVNSA GKVAISAKEIKEDNIGAQVLGLFTLSTGQD SWNQTN (SEQ ID NO: 26) | (N/A) |
| VRT-309 | DKTHTCPPCPAPEAAGAPSVFL FPPKPKDTLMISRTPEVTCVVV DVSHEDPEVKFNWYVDGVEVHN AKTKPREEQQNSTYRVVSVLTV LHQDWLNGKEYKCKVSNKALKA PIEKTISKAKGQPREPQVYTLP PSRDELTKNQVSLWCLVKGFYP SDIAVEWESNGQPENNYKTTPP VLDSDGSFFLYSKLTVDKSRWQ QGNVFSCSVMHEALHNHYTQKS LSLSPG (SEQ ID NO: 24) | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNASIGMKKYFVGVNSA GKVAISAKEIKEDNIGAQVLGLFTLSTGQD SWNQTN (SEQ ID NO: 26) | (N/A) |
| VRT-310 | DKTHTCPPCPAPEAAGAPSVEL FPPKPKDTLMISRTPEVTCVVV DVSHEDPEVKFNWYVDGVEVHN AKTKPREEQQNSTYRVVSVLIV LHQDWLNGKEYKCKVSNKALKA PIEKTISKAKGQPREPQVYTLP PSRDELTKNQVSLTCLVKGFYP SDIAVEWESNGQPENNYKTTPP VLDSDGSFFLYSKLTVDKSRWQ QGNVFSCSVMHEALHNHYTQKS LSLSPG (SEQ ID NO: 23) | ANQEIRYSEVTPYHVTSVWTKGVTPPAQFT QGEDVFHAPYVANQGWYDITKTFNGKDDLL CGAATAGNMLHWWFDQNKDQIKRYLEEHPE KQKINFNGEQMFDVKEAIDTKNHQLDSKLF EYFKEKAFPYLSTKHLGVFPDHVIDMFING YRLSLTNHGPTPVKEGSKDPRGGIFDAVFT RGDQSKLLTSRHDFKEKNLKEISDLIKKEL TEGKALGLSHTYANVRINHVINLWGADFDS NGNLKAIYVTDSDSNAQIGMKKYFVGVNSA GKVAISAKEIKEDNIGAQVLGLFTLSTGQD SWNQTN (SEQ ID NO: 29) | (N/A) |

TABLE 11

| ID | C-terminus IdeS | Fc | C-terminus IdeS | C-terminus His-tag |
|---|---|---|---|---|
| VRT-311 | ANQEIRYSEVTPYHVTSVWTKGVTPPAQFTQGEDVFHAPYVANQGWYDITKTENGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVETRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 26) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | ANQEIRYSEVTPYHVTSVWTKGVTPPAQFTQGEDVFHAPYVANQGWYDITKTENGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVETRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 26) | HHHHHHHH (SEQ ID NO: 27) |
| VRT-312 | ANQEIRYSEVTPYHVTSVWTKGVTPPAQFTQGEDVFHAPYVANQGWYDITKTENGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVETRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 26) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | ANQEIRYSEVTPYHVTSVWTKGVTPPAQFTQGEDVFHAPYVANQGWYDITKTENGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLINHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN (SEQ ID NO: 26) | (N/A) |

TABLE 12

| ID | N-terminus VHH | N-terminus IdeS | Fc | C-terminus His-tag |
|---|---|---|---|---|
| VRT-313 | QVQLQESGGGLVQAGGSLRLSCAASGYISDAYYMGWYRQAPGKEREFVATITHGTNTYYADSVKGRFTISRDNAKNTVYLQMNSLKPEDTAVYYCAVLETRSYSFRYWGQGTQVTVSSLEGGGGS (SEQ ID NO: 30) | ANQEIRYSEVTPYHVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVETRGDQSKLLTSRHDFKEKNLKEISDLIKKELTEGKALGLSHTYANVRINHVINLWGADFDSNGNLKAIYVTDSDSNAQIGMKKYFVGVNSAGKVAISAKEIKEDNIGAQVLGLFTLSTGQDSWNQTN (SEQ ID NO: 29) | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG (SEQ ID NO: 23) | HHHHHHHH (SEQ ID NO: 27) |
| VRT-314 | QVQLQESGGGLVQAGGSLRLSCAASGYISDAYYMGWYRQAPGKEREFVATITHGTNTYYADSVKGRFTISRDNAKNTVYLQMNSLKPEDTAVYYCAVLET | ANQEIRYSEVTPYHVTSVWTKGVTPPAQFTQGEDVFHAPYVANQGWYDITKTFNGKDDLLCGAATAGNMLHWWFDQNKDQIKRYLEEHPEKQKMEDVKEAIDTKNHQLDSKLFEYFKEKAFPYLSTKHLGVFPDHVIDMFINGYRLSLINHGPTPVKEGSKDPRGGIFDAVFTRGDQSKLLTSRHDFKEKNLKEISDLIKKELTEGKALGLSHTYANVRINHV | DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENN | (N/A) |

TABLE 12-continued

| ID | N-terminus VHH | N-terminus IdeS | Fc | C-terminus His-tag |
|---|---|---|---|---|
| | RSYSFRYWGQ GTQVTVSSLE GGGGS (SEQ ID NO: 30) | INLWGADFDSNGNLKAIYVTDSD SNAQIGMKKYFVGVNSAGKVAIS AKEIKEDNIGAQVLGLFTLSTGQ DSWNQTN (SEQ ID NO: 29) | YKTTPPVLDSDGSFFLY SKLTVDKSRWQQGNVFS CSVMHEALHNHYTQKSL SLSPG (SEQ ID NO: 23) | |

TABLE 13

| ID | Fc | C-terminus IdeS | N-terminus VHH | C-terminus His-tag |
|---|---|---|---|---|
| VRT-315 | DKTHTCPPCPAPEAAGA PSVFLFPPKPKDTLMIS RTPEVTCVVVDVSHEDP EVKFNWYVDGVEVHNAK TKPREEQQNSTYRVVSV LTVLHQDWLNGKEYKCK VSNKALKAPIEKTISKA KGQPREPQVYTLPPSRD ELTKNQVSLTCLVKGFY PSDIAVEWESNGQPENN YKTTPPVLDSDGSFFLY SKLTVDKSRWQQGNVFS CSVMHEALHNHYTQKSL SLSPG (SEQ ID NO: 23) | ANQEIRYSEVTPYHVTSVWTKGV TPPAQFTQGEDVFHAPYVANQGW YDITKTFNGKDDLLCGAATAGNM LHWWFDQNKDQIKRYLEEHPEKQ KINFNGEQMFDVKEAIDTKNHQL DSKLFEYFKEKAFPYLSTKHLGV FPDHVIDMFINGYRLSLTNHGPT PVKEGSKDPRGGIFDAVETRGDQ SKLLTSRHDFKEKNLKEISDLIK KELTEGKALGLSHTYANVRINHV INLWGADFDSNGNLKAIYVTDSD SNAQIGMKKYFVGVNSAGKVAIS AKEIKEDNIGAQVLGLFTLSTGQ DSWNQTNGGGGS (SEQ ID NO: 31) | QVQLQESGGG LVQAGGSLRL SCAASGYISD AYYMGWYRQA PGKEREFVAT ITHGTNTYYA DSVKGRFTIS RDNAKNTVYL QMNSLKPEDT AVYYCAVLET RSYSFRYWGQ GTQVTVSSLE GG (SEQ ID NO: 32) | HHHHHHHH (SEQ ID NO: 27) |
| VRT-316 | DKTHTCPPCPAPEAAGA PSVFLFPPKPKDTLMIS RTPEVTCVVVDVSHEDP EVKFNWYVDGVEVHNAK TKPREEQQNSTYRVVSV LTVLHQDWLNGKEYKCK VSNKALKAPIEKTISKA KGQPREPQVYTLPPSRD ELTKNQVSLTCLVKGFY PSDIAVEWESNGQPENN YKTTPPVLDSDGSFFLY SKLTVDKSRWQQGNVFS CSVMHEALHNHYTQKSL SLSPG (SEQ ID NO: 23) | ANQEIRYSEVTPYHVTSVWTKGV TPPAQFTQGEDVFHAPYVANQGW YDITKTFNGKDDLLCGAATAGNM LHWWFDQNKDQIKRYLEEHPEKQ KINFNGEQMFDVKEAIDTKNHQL DSKLFEYFKEKAFPYLSTKHLGV FPDHVIDMFINGYRLSLINHGPT PVKEGSKDPRGGIFDAVFTRGDQ SKLLTSRHDFKEKNLKEISDLIK KELTEGKALGLSHTYANVRINHV INLWGADFDSNGNLKAIYVTDSD SNAQIGMKKYFVGVNSAGKVAIS AKEIKEDNIGAQVLGLFTLSTGQ DSWNQTNGGGGS (SEQ ID NO: 31) | QVQLQESGGG LVQAGGSLRL SCAASGYISD AYYMGWYRQA PGKEREFVAT ITHGTNTYYA DSVKGRFTIS RDNAKNTVYL QMNSLKPEDT AVYYCAVLET RSYSFRYWGQ GTQVTVSSLE (SEQ ID NO: 33) | (N/A) |

In some embodiments, the polypeptides do not comprise the histidine illustrated in the table above.

In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to any one amino acid sequence selected from SEQ ID NO: 1023-1289, 1311-1329, and 1334-1336. Additional support for specific embodiments of polypeptides comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to any one amino acid sequence selected from SEQ ID NO: 1023-1289, 1311-1329, and 1334-1336 may be found in U.S. Provisional Application No. 63/478,789, filed Jan. 6, 2023, U.S. Provisional Application No. 63/483,142, filed Feb. 3, 2023, U.S. Provisional Application No. 63/493,142, filed Mar. 31, 2023, U.S. Provisional Application No. 63/506,539, filed Jun. 6, 2023, and/or U.S. Provisional Application No. 63/600,157, filed Nov. 17, 2023, each of which is hereby incorporated by reference in its entirety.

In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1311. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1312. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1313. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1314. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1315. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1316. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1317. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1318. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1319. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1320. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1321. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1322. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1323. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1324. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1325. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1326. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1327. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1328. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1329. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1334. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1335. In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to the amino acid sequence of SEQ ID NO: 1336.

In some embodiments, a polypeptide comprises the amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 1023-1289, 1311-1329, and 1334-1336, provided that the polypeptide comprises an amino acid sequence selected from any one of SEQ ID NO: 753-1019, 1290-1310 and 1333.

In some embodiments, a polypeptide comprises an amino acid sequence selected from SEQ ID NO: 1023-1289, 1311-1329, and 1334-1336. In some embodiments, a polypeptide comprises an amino acid sequence of SEQ ID NO: 1023. In some embodiments, a polypeptide comprises an amino acid sequence of SEQ ID NO: 1024. In some embodiments, a polypeptide comprises an amino acid sequence of SEQ ID NO: 1025. In some embodiments, a polypeptide comprises an amino acid sequence of SEQ ID NO: 1026. In some embodiments, a polypeptide comprises an amino acid sequence of SEQ ID NO: 1027. In some embodiments, a polypeptide comprises an amino acid sequence of SEQ ID NO: 1028. In some embodiments, a polypeptide comprises an amino acid sequence of SEQ ID NO: 1029. In some embodiments, a polypeptide comprises an amino acid sequence of SEQ ID NO: 1030. In some embodiments, a polypeptide comprises an amino acid sequence of SEQ ID NO: 1031. In some embodiments, a polypeptide comprises an amino acid sequence of SEQ ID NO: 1032. In some embodiments, a polypeptide comprises an amino acid sequence of SEQ ID NO: 1033. In some embodiments, a polypeptide comprises an amino acid sequence of SEQ ID NO: 1034. In some embodiments, a polypeptide comprises an amino acid sequence of SEQ ID NO: 1035. In some embodiments, a polypeptide comprises an amino acid sequence of SEQ ID NO: 1036. In some embodiments, a polypeptide comprises an amino acid sequence of SEQ ID NO: 1037. In some embodiments, a polypeptide comprises an amino acid sequence of SEQ ID NO: 1038. In some embodiments, a polypeptide comprises an amino acid sequence of SEQ ID NO: 1039. In some embodiments, a polypeptide comprises an amino acid sequence of SEQ ID NO: 1040. In some embodiments, a polypeptide comprises an amino acid sequence of SEQ ID NO: 1041. In some embodiments, a polypeptide comprises an amino acid sequence of SEQ ID NO: 1042. In some embodiments, a polypeptide comprises an amino acid sequence of SEQ ID NO: 1043. In some embodiments, a polypeptide comprises an amino acid sequence of SEQ ID NO: 1044. In some embodiments, a polypeptide comprises an amino acid sequence of SEQ ID NO: 1045. In some embodiments, a polypeptide comprises an amino acid sequence of SEQ ID NO: 1046. In some embodiments, a polypeptide comprises an amino acid sequence of SEQ ID NO: 1047. In some embodiments, a polypeptide comprises an amino acid sequence of SEQ ID NO: 1048. In some embodiments, a polypeptide comprises an amino acid sequence of SEQ ID NO: 1049. In some embodiments, a polypeptide comprises an amino acid sequence of SEQ ID NO: 1050. In some embodiments, a polypeptide comprises an amino acid sequence of SEQ ID NO: 1051. In some embodiments, a polypeptide comprises an amino acid sequence of SEQ ID NO: 1052. In some embodiments, a polypeptide comprises an amino acid sequence of SEQ ID NO: 1053. In some embodiments, a polypeptide comprises an amino acid sequence of SEQ ID NO: 1054. In some embodiments, a polypeptide comprises an amino acid sequence of SEQ ID NO: 1055. In some embodiments, a polypeptide comprises an amino acid sequence of SEQ ID NO: 1056. In some embodiments, a polypeptide comprises an amino acid sequence of SEQ ID NO: 1057. In some embodiments, a polypeptide comprises an amino acid sequence of SEQ ID NO: 1058. In some embodiments, a polypeptide comprises an amino acid sequence of SEQ ID NO: 1059. In some embodiments, a polypeptide comprises an amino acid sequence of SEQ ID NO: 1060. In some embodiments, a polypeptide comprises an amino acid sequence of SEQ ID NO: 1061. In some embodiments, a polypeptide comprises an amino acid sequence of SEQ ID NO: 1062. In some embodiments, a polypeptide comprises an amino acid sequence of SEQ ID NO: 1063. In some embodiments, a polypeptide comprises an amino acid sequence of SEQ ID NO: 1064. In some embodiments, a polypeptide comprises an amino acid sequence of SEQ ID NO: 1065. In some embodiments, a polypeptide comprises an amino acid sequence of SEQ ID NO: 1066. In some embodiments, a polypeptide comprises an amino acid sequence of SEQ ID NO: 1067. In some embodiments, a polypeptide comprises an amino acid sequence of SEQ ID NO: 1068. In some embodiments, a polypeptide comprises an amino acid sequence of SEQ ID NO: 1069. In some embodiments, a polypeptide comprises an amino acid sequence of SEQ ID NO: 1070. In some embodiments, a polypeptide comprises an amino acid sequence of SEQ ID NO: 1071. In some embodiments, a polypeptide comprises an amino acid sequence of SEQ ID NO: 1072. In some embodiments, a polypeptide comprises an amino acid sequence of SEQ ID NO: 1073. In some embodiments, a polypeptide comprises an amino acid sequence of SEQ ID NO: 1074. In some embodiments, a polypeptide comprises an amino acid sequence of SEQ ID NO: 1075. In some embodiments, a polypeptide comprises an amino acid sequence of SEQ ID NO: 1076. In some embodiments, a polypeptide comprises an amino acid sequence of SEQ ID NO: 1077. In some embodiments, a polypeptide comprises an amino acid sequence of SEQ ID NO: 1078. In some embodiments, a polypeptide comprises an amino acid sequence of SEQ ID NO: 1079. In some embodiments, a polypeptide comprises an amino acid sequence of SEQ ID NO: 1080. In some embodiments, a polypeptide comprises an amino acid sequence of SEQ ID NO: 1081. In some embodiments, a polypeptide comprises an amino acid sequence of SEQ ID NO: 1082. In some embodiments, a polypeptide comprises an amino acid sequence of SEQ ID NO: 1083. In some embodiments, a polypeptide comprises an amino acid sequence of SEQ ID NO: 1084. In some embodiments, a polypeptide comprises an amino acid sequence of SEQ ID NO: 1085. In some embodiments, a polypeptide comprises an amino acid sequence of SEQ ID NO: 1086. In some embodiments, a polypeptide comprises an amino acid sequence of SEQ ID NO: 1087. In some embodiments, a polypeptide comprises an amino acid sequence of SEQ ID NO: 1088. In some embodiments, a polypeptide comprises an amino acid sequence of SEQ ID NO: 1089. In some embodiments, a polypeptide comprises an amino acid sequence of SEQ ID NO: 1090. In some embodiments, a polypeptide comprises an amino acid sequence of SEQ ID NO: 1091. In some embodiments, a polypeptide comprises an amino acid sequence of SEQ ID NO: 1092. In some embodiments, a polypeptide comprises an amino acid sequence of SEQ ID NO: 1093. In some embodiments, a polypeptide comprises an amino acid sequence of SEQ ID NO: 1094. In some embodiments, a polypeptide comprises an amino acid sequence of SEQ ID NO: 1095. In some embodiments, a polypeptide comprises an amino acid sequence of SEQ ID NO: 1096. In some embodiments, a polypeptide comprises an amino acid sequence of SEQ ID NO: 1097. In some embodiments, a polypeptide comprises an amino acid sequence of SEQ ID NO: 1098. In some embodiments, a polypeptide comprises an amino acid sequence of SEQ ID NO: 1099. In some embodiments, a polypeptide comprises an amino acid sequence of SEQ ID NO: 1100. In some embodiments, a polypeptide comprises an amino acid sequence of SEQ ID NO: 1101. In some embodiments, a polypeptide comprises an amino acid sequence of SEQ ID NO: 1102. In some embodiments, a polypeptide comprises an amino acid sequence of SEQ ID NO: 1103. In some embodiments, a polypeptide comprises an amino acid sequence of SEQ ID NO: 1104. In some embodiments, a polypeptide comprises an amino acid sequence of SEQ ID NO: 1105. In some embodiments, a polypeptide comprises an amino acid sequence of SEQ ID NO: 1106. In some embodiments, a polypeptide comprises an amino acid sequence of SEQ ID NO: 1107. In some embodiments, a polypeptide comprises an amino acid sequence of SEQ ID NO: 1108. In some embodiments, a polypeptide comprises an amino acid sequence of SEQ ID NO: 1109. In some embodiments, a polypeptide comprises an amino acid sequence of SEQ ID NO: 1110. In some embodiments, a polypeptide comprises an amino acid sequence of SEQ ID NO: 1111. In some embodiments, a polypeptide comprises an amino acid sequence of SEQ ID NO: 1112. In some embodiments, a polypeptide comprises an amino acid sequence of SEQ ID NO: 1113. In some embodiments, a polypeptide comprises an amino acid sequence of SEQ ID NO: 1114. In some embodiments, a polypeptide comprises an amino acid sequence of SEQ ID NO: 1115. In some embodiments, a polypeptide comprises an amino acid sequence of SEQ ID NO: 1116. In some embodiments, a polypeptide comprises an amino acid sequence of SEQ ID NO: 1117. In some embodiments, a polypeptide comprises an amino acid sequence of SEQ ID NO: 1118. In some embodiments, a polypeptide comprises an amino acid sequence of SEQ ID NO: 1119. In some embodiments, a polypeptide comprises an amino acid sequence of SEQ ID NO: 1120. In some embodiments, a polypeptide comprises an amino acid sequence of SEQ ID NO: 1121. In some embodiments, a polypeptide comprises an amino acid sequence of SEQ ID NO: 1122. In some embodiments, a polypeptide comprises an amino acid sequence of SEQ ID NO: 1123. In some embodiments, a polypeptide comprises an amino acid sequence of SEQ ID NO: 1124. In some embodiments, a polypeptide comprises an amino acid sequence of SEQ ID NO: 1125. In some embodiments, a polypeptide comprises an amino acid sequence of SEQ ID NO: 1126. In some embodiments, a polypeptide comprises an amino acid sequence of SEQ ID NO: 1127. In some embodiments, a polypeptide comprises an amino acid sequence of SEQ ID NO: 1128. In some embodiments, a polypeptide comprises an amino acid sequence of SEQ ID NO: 1129. In some embodiments, a polypeptide comprises an amino acid sequence of SEQ ID NO: 1130. In some embodiments, a polypeptide comprises an amino acid sequence of SEQ ID NO: 1131. In some embodiments, a polypeptide comprises an amino acid sequence of SEQ ID NO: 1132. In some embodiments, a polypeptide comprises an amino acid sequence of SEQ ID NO: 1133. In some embodiments, a polypeptide comprises an amino acid sequence of SEQ ID NO: 1134. In some embodiments, a polypeptide comprises an amino acid sequence of SEQ ID NO: 1135. In some embodiments, a polypeptide comprises an amino acid sequence of SEQ ID NO: 1136. In some embodiments, a polypeptide comprises an amino acid sequence of SEQ ID NO: 1137. In some embodiments, a polypeptide comprises an amino acid sequence of SEQ ID NO: 1138. In some embodiments, a polypeptide comprises an amino acid sequence of SEQ ID NO: 1139. In some embodiments, a polypeptide comprises an amino acid sequence of SEQ ID NO: 1140. In some embodiments, a polypeptide comprises an amino acid sequence of SEQ ID NO: 1141. In some embodiments, a polypeptide comprises an amino acid sequence of SEQ ID NO: 1142. In some embodiments, a polypeptide comprises an amino acid sequence of SEQ ID NO: 1143. In some embodiments, a polypeptide comprises an amino acid sequence of SEQ ID NO: 1144. In some embodiments, a polypeptide comprises an amino acid sequence of SEQ ID NO: 1145. In some embodiments, a polypeptide comprises an amino acid sequence of SEQ ID NO: 1146. In some embodiments, a polypeptide comprises an amino acid sequence of SEQ ID NO: 1147. In some embodiments, a polypeptide comprises an amino acid sequence of SEQ ID NO: 1148. In some embodiments, a polypeptide comprises an amino acid sequence of SEQ ID NO: 1149. In some embodiments, a polypeptide comprises an amino acid sequence of SEQ ID NO: 1150. In some embodiments, a polypeptide comprises an amino acid sequence of SEQ ID NO: 1151. In some embodiments, a polypeptide comprises an amino acid sequence of SEQ ID NO: 1152. In some embodiments, a polypeptide comprises an amino acid sequence of SEQ ID NO: 1153. In some embodiments, a polypeptide comprises an amino acid sequence of SEQ ID NO: 1154. In some embodiments, a polypeptide comprises an amino acid sequence of SEQ ID NO: 1155. In some embodiments, a polypeptide comprises an amino acid sequence of SEQ ID NO: 1156. In some embodiments, a polypeptide comprises an amino acid sequence of SEQ ID NO: 1157. In some embodiments, a polypeptide comprises an amino acid sequence of SEQ ID NO: 1158. In some embodiments, a polypeptide comprises an amino acid sequence of SEQ ID NO: 1159. In some embodiments, a polypeptide comprises an amino acid sequence of SEQ ID NO: 1160. In some embodiments, a polypeptide comprises an amino acid sequence of SEQ ID NO: 1161. In some embodiments, a polypeptide comprises an amino acid sequence of SEQ ID NO: 1162. In some embodiments, a polypeptide comprises an amino acid sequence of SEQ ID NO: 1163. In some embodiments, a polypeptide comprises an amino acid sequence of SEQ ID NO: 1164. In some embodiments, a polypeptide comprises an amino acid sequence of SEQ ID NO: 1165. In some embodiments, a polypeptide comprises an amino acid sequence of SEQ ID NO: 1166. In some embodiments, a polypeptide comprises an amino acid sequence of SEQ ID NO: 1167. In some embodiments, a polypeptide comprises an amino acid sequence of SEQ ID NO: 1168. In some embodiments, a polypeptide comprises an amino acid sequence of SEQ ID NO: 1169. In some embodiments, a polypeptide comprises an amino acid sequence of SEQ ID NO: 1170. In some embodiments, a polypeptide comprises an amino acid sequence of SEQ ID NO: 1171. In some embodiments, a polypeptide comprises an amino acid sequence of SEQ ID NO: 1172. In some embodiments, a polypeptide comprises an amino acid sequence of SEQ ID NO: 1173. In some embodiments, a polypeptide comprises an amino acid sequence of SEQ ID NO: 1174. In some embodiments, a polypeptide comprises an amino acid sequence of SEQ ID NO: 1175. In some embodiments, a polypeptide comprises an amino acid sequence of SEQ ID NO: 1176. In some embodiments, a polypeptide comprises an amino acid sequence of SEQ ID NO: 1177. In some embodiments, a polypeptide comprises an amino acid sequence of SEQ ID NO: 1178. In some embodiments, a polypeptide comprises an amino acid sequence of SEQ ID NO: 1179. In some embodiments, a polypeptide comprises an amino acid sequence of SEQ ID NO: 1180. In some embodiments, a polypeptide comprises an amino acid sequence of SEQ ID NO: 1181. In some embodiments, a polypeptide comprises an amino acid sequence of SEQ ID NO: 1182. In some embodiments, a polypeptide comprises an amino acid sequence of SEQ ID NO: 1183. In some embodiments, a polypeptide comprises an amino acid sequence of SEQ ID NO: 1184. In some embodiments, a polypeptide comprises an amino acid sequence of SEQ ID NO: 1185. In some embodiments, a polypeptide comprises an amino acid sequence of SEQ ID NO: 1186. In some embodiments, a polypeptide comprises an amino acid sequence of SEQ ID NO: 1187. In some embodiments, a polypeptide comprises an amino acid sequence of SEQ ID NO: 1188. In some embodiments, a polypeptide comprises an amino acid sequence of SEQ ID NO: 1189. In some embodiments, a polypeptide comprises an amino acid sequence of SEQ ID NO: 1190. In some embodiments, a polypeptide comprises an amino acid sequence of SEQ ID NO: 1191. In some embodiments, a polypeptide comprises an amino acid sequence of SEQ ID NO: 1192. In some embodiments, a polypeptide comprises an amino acid sequence of SEQ ID NO: 1193. In some embodiments, a polypeptide comprises an amino acid sequence of SEQ ID NO: 1194. In some embodiments, a polypeptide comprises an amino acid sequence of SEQ ID NO: 1195. In some embodiments, a polypeptide comprises an amino acid sequence of SEQ ID NO: 1196. In some embodiments, a polypeptide comprises an amino acid sequence of SEQ ID NO: 1197. In some embodiments, a polypeptide comprises an amino acid sequence of SEQ ID NO: 1198. In some embodiments, a polypeptide comprises an amino acid sequence of SEQ ID NO: 1199. In some embodiments, a polypeptide comprises an amino acid sequence of SEQ ID NO: 1200. In some embodiments, a polypeptide comprises an amino acid sequence of SEQ ID NO: 1201. In some embodiments, a polypeptide comprises an amino acid sequence of SEQ ID NO: 1202. In some embodiments, a polypeptide comprises an amino acid sequence of SEQ ID NO: 1203. In some embodiments, a polypeptide comprises an amino acid sequence of SEQ ID NO: 1204. In some embodiments, a polypeptide comprises an amino acid sequence of SEQ ID NO: 1205. In some embodiments, a polypeptide comprises an amino acid sequence of SEQ ID NO: 1206. In some embodiments, a polypeptide comprises an amino acid sequence of SEQ ID NO: 1207. In some embodiments, a polypeptide comprises an amino acid sequence of SEQ ID NO: 1208. In some embodiments, a polypeptide comprises an amino acid sequence of SEQ ID NO: 1209. In some embodiments, a polypeptide comprises an amino acid sequence of SEQ ID NO: 1210. In some embodiments, a polypeptide comprises an amino acid sequence of SEQ ID NO: 1211. In some embodiments, a polypeptide comprises an amino acid sequence of SEQ ID NO: 1212. In some embodiments, a polypeptide comprises an amino acid sequence of SEQ ID NO: 1213. In some embodiments, a polypeptide comprises an amino acid sequence of SEQ ID NO: 1214. In some embodiments, a polypeptide comprises an amino acid sequence of SEQ ID NO: 1215. In some embodiments, a polypeptide comprises an amino acid sequence of SEQ ID NO: 1216. In some embodiments, a polypeptide comprises an amino acid sequence of SEQ ID NO: 1217. In some embodiments, a polypeptide comprises an amino acid sequence of SEQ ID NO: 1218. In some embodiments, a polypeptide comprises an amino acid sequence of SEQ ID NO: 1219. In some embodiments, a polypeptide comprises an amino acid sequence of SEQ ID NO: 1220. In some embodiments, a polypeptide comprises an amino acid sequence of SEQ ID NO: 1221. In some embodiments, a polypeptide comprises an amino acid sequence of SEQ ID NO: 1222. In some embodiments, a polypeptide comprises an amino acid sequence of SEQ ID NO: 1223. In some embodiments, a polypeptide comprises an amino acid sequence of SEQ ID NO: 1224. In some embodiments, a polypeptide comprises an amino acid sequence of SEQ ID NO: 1225. In some embodiments, a polypeptide comprises an amino acid sequence of SEQ ID NO: 1226. In some embodiments, a polypeptide comprises an amino acid sequence of SEQ ID NO: 1227. In some embodiments, a polypeptide comprises an amino acid sequence of SEQ ID NO: 1228. In some embodiments, a polypeptide comprises an amino acid sequence of SEQ ID NO: 1229. In some embodiments, a polypeptide comprises an amino acid sequence of SEQ ID NO: 1230. In some embodiments, a polypeptide comprises an amino acid sequence of SEQ ID NO: 1231. In some embodiments, a polypeptide comprises an amino acid sequence of SEQ ID NO: 1232. In some embodiments, a polypeptide comprises an amino acid sequence of SEQ ID NO: 1233. In some embodiments, a polypeptide comprises an amino acid sequence of SEQ ID NO: 1234. In some embodiments, a polypeptide comprises an amino acid sequence of SEQ ID NO: 1235. In some embodiments, a polypeptide comprises an amino acid sequence of SEQ ID NO: 1236. In some embodiments, a polypeptide comprises an amino acid sequence of SEQ ID NO: 1237. In some embodiments, a polypeptide comprises an amino acid sequence of SEQ ID NO: 1238. In some embodiments, a polypeptide comprises an amino acid sequence of SEQ ID NO: 1239. In some embodiments, a polypeptide comprises an amino acid sequence of SEQ ID NO: 1240. In some embodiments, a polypeptide comprises an amino acid sequence of SEQ ID NO: 1241. In some embodiments, a polypeptide comprises an amino acid sequence of SEQ ID NO: 1242. In some embodiments, a polypeptide comprises an amino acid sequence of SEQ ID NO: 1243. In some embodiments, a polypeptide comprises an amino acid sequence of SEQ ID NO: 1244. In some embodiments, a polypeptide comprises an amino acid sequence of SEQ ID NO: 1245. In some embodiments, a polypeptide comprises an amino acid sequence of SEQ ID NO: 1246. In some embodiments, a polypeptide comprises an amino acid sequence of SEQ ID NO: 1247. In some embodiments, a polypeptide comprises an amino acid sequence of SEQ ID NO: 1248. In some embodiments, a polypeptide comprises an amino acid sequence of SEQ ID NO: 1249. In some embodiments, a polypeptide comprises an amino acid sequence of SEQ ID NO: 1250. In some embodiments, a polypeptide comprises an amino acid sequence of SEQ ID NO: 1251. In some embodiments, a polypeptide comprises an amino acid sequence of SEQ ID NO: 1252. In some embodiments, a polypeptide comprises an amino acid sequence of SEQ ID NO: 1253. In some embodiments, a polypeptide comprises an amino acid sequence of SEQ ID NO: 1254. In some embodiments, a polypeptide comprises an amino acid sequence of SEQ ID NO: 1255. In some embodiments, a polypeptide comprises an amino acid sequence of SEQ ID NO: 1256. In some embodiments, a polypeptide comprises an amino acid sequence of SEQ ID NO: 1257. In some embodiments, a polypeptide comprises an amino acid sequence of SEQ ID NO: 1258. In some embodiments, a polypeptide comprises an amino acid sequence of SEQ ID NO: 1259. In some embodiments, a polypeptide comprises an amino acid sequence of SEQ ID NO: 1260. In some embodiments, a polypeptide comprises an amino acid sequence of SEQ ID NO: 1261. In some embodiments, a polypeptide comprises an amino acid sequence of SEQ ID NO: 1262. In some embodiments, a polypeptide comprises an amino acid sequence of SEQ ID NO: 1263. In some embodiments, a polypeptide comprises an amino acid sequence of SEQ ID NO: 1264. In some embodiments, a polypeptide comprises an amino acid sequence of SEQ ID NO: 1265. In some embodiments, a polypeptide comprises an amino acid sequence of SEQ ID NO: 1266. In some embodiments, a polypeptide comprises an amino acid sequence of SEQ ID NO: 1267. In some embodiments, a polypeptide comprises an amino acid sequence of SEQ ID NO: 1268. In some embodiments, a polypeptide comprises an amino acid sequence of SEQ ID NO: 1269. In some embodiments, a polypeptide comprises an amino acid sequence of SEQ ID NO: 1270. In some embodiments, a polypeptide comprises an amino acid sequence of SEQ ID NO: 1271. In some embodiments, a polypeptide comprises an amino acid sequence of SEQ ID NO: 1272. In some embodiments, a polypeptide comprises an amino acid sequence of SEQ ID NO: 1273. In some embodiments, a polypeptide comprises an amino acid sequence of SEQ ID NO: 1274. In some embodiments, a polypeptide comprises an amino acid sequence of SEQ ID NO: 1275. In some embodiments, a polypeptide comprises an amino acid sequence of SEQ ID NO: 1276. In some embodiments, a polypeptide comprises an amino acid sequence of SEQ ID NO: 1277. In some embodiments, a polypeptide comprises an amino acid sequence of SEQ ID NO: 1278. In some embodiments, a polypeptide comprises an amino acid sequence of SEQ ID NO: 1279. In some embodiments, a polypeptide comprises an amino acid sequence of SEQ ID NO: 1280. In some embodiments, a polypeptide comprises an amino acid sequence of SEQ ID NO: 1281. In some embodiments, a polypeptide comprises an amino acid sequence of SEQ ID NO: 1282. In some embodiments, a polypeptide comprises an amino acid sequence of SEQ ID NO: 1283. In some embodiments, a polypeptide comprises an amino acid sequence of SEQ ID NO: 1284. In some embodiments, a polypeptide comprises an amino acid sequence of SEQ ID NO: 1285. In some embodiments, a polypeptide comprises an amino acid sequence of SEQ ID NO: 1286. In some embodiments, a polypeptide comprises an amino acid sequence of SEQ ID NO: 1287. In some embodiments, a polypeptide comprises an amino acid sequence of SEQ ID NO: 1288. In some embodiments, a polypeptide comprises an amino acid sequence of SEQ ID NO: 1289. In some embodiments, a polypeptide comprises an amino acid sequence of SEQ ID NO: 1311. In some embodiments, a polypeptide comprises an amino acid sequence of SEQ ID NO: 1312. In some embodiments, a polypeptide comprises an amino acid sequence of SEQ ID NO: 1313. In some embodiments, a polypeptide comprises an amino acid sequence of SEQ ID NO: 1314. In some embodiments, a polypeptide comprises an amino acid sequence of SEQ ID NO: 1315. In some embodiments, a polypeptide comprises an amino acid sequence of SEQ ID NO: 1316. In some embodiments, a polypeptide comprises an amino acid sequence of SEQ ID NO: 1317. In some embodiments, a polypeptide comprises an amino acid sequence of SEQ ID NO: 1318. In some embodiments, a polypeptide comprises an amino acid sequence of SEQ ID NO: 1319. In some embodiments, a polypeptide comprises an amino acid sequence of SEQ ID NO: 1320. In some embodiments, a polypeptide comprises an amino acid sequence of SEQ ID NO: 1321. In some embodiments, a polypeptide comprises an amino acid sequence of SEQ ID NO: 1322. In some embodiments, a polypeptide comprises an amino acid sequence of SEQ ID NO: 1323. In some embodiments, a polypeptide comprises an amino acid sequence of SEQ ID NO: 1324. In some embodiments, a polypeptide comprises an amino acid sequence of SEQ ID NO: 1325. In some embodiments, a polypeptide comprises an amino acid sequence of SEQ ID NO: 1326. In some embodiments, a polypeptide comprises an amino acid sequence of SEQ ID NO: 1327. In some embodiments, a polypeptide comprises an amino acid sequence of SEQ ID NO: 1328. In some embodiments, a polypeptide comprises an amino acid sequence of SEQ ID NO: 1329. In some embodiments, a polypeptide comprises an amino acid sequence of SEQ ID NO: 1334. In some embodiments, a polypeptide comprises an amino acid sequence of SEQ ID NO: 1335. In some embodiments, a polypeptide comprises an amino acid sequence of SEQ ID NO: 1336.

As provided for herein, the polypeptides can also comprise a leader sequence attached to the N-terminus of the protein. For example, in some embodiments, the polypeptide has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 1023-1289, 1311-1329, and 1334-1336, and further comprises a leader amino acid sequence. In some embodiments, the polypeptide has an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one amino acid sequence selected from SEQ ID NO: 1023-1289, 1311-1329, and 1334-1336, and further comprises a leader amino acid sequence having an amino acid sequence of METDTLLLWVLLLWVPGSTG (SEQ ID NO: 1357), or MGWSCIILFLVATATGVHS (SEQ ID NO: 1358). In some embodiments, the leader amino acid sequence is N-terminal to the polypeptide. In some embodiments, the leader amino acid sequence facilitates expression of the polypeptide. In some embodiments, the leader amino acid sequence is processed and removed from the polypeptide during expression ex vivo or in vivo.

In some embodiments, a polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity, or is identical, to any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT- 149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316.

In some embodiments, the polypeptide that is less than 100% identical to the reference sequence retains the protease activity and the Fc polypeptide is protease resistant. In some embodiments, the protease resistant Fc polypeptide comprise a Y296Q and/or a P329K mutation. In some embodiments, the protease resistant Fc polypeptide comprises a L234A, L235A, and/or G237A mutation. In some embodiments, the protease resistant Fc polypeptide comprises one, two, or each of L234A, L235A, and/or G237A mutations and one or both of Y296Q and/or a P329K mutations. In some embodiments, the protease resistant Fc polypeptide comprises a set of L234A, L235A, G237A, Y296Q and P329K mutations.

In some embodiments, a polypeptide comprises an amino acid sequence of any one of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316.

In some embodiments, two (or more) polypeptides associate, either covalently or non-covalently, e.g., to form a hetero or homo-dimeric therapeutic compound. In some embodiments, the linker can comprise an Fc region and two Fc regions associate with one another. In some embodiments of a therapeutic compound comprising two linker regions, the linker regions can self-associate, e.g., as two identical Fc regions. In some embodiments of a therapeutic compound comprising two linker regions, the linker regions are not capable of, or not capable of substantial, self-association, e.g., the two Fc regions can be members of a knob and hole pair.

In some embodiments, a polypeptide can associate with another polypeptide. In some embodiments, the polypeptide associated with another polypeptide forms a dimer molecule. In some embodiments, the polypeptide comprises a first polypeptide and a second polypeptide. In some embodiments, the first polypeptide comprises a knob mutation, and the second polypeptide comprises a hole mutation. In some embodiments, the first polypeptide comprises a hole mutation, and the second polypeptide comprises a knob mutation. In some embodiments, the knob mutation is such as those provided herein. In some embodiments, the hole mutation is such as those provided herein.

In some embodiments, a dimer molecule comprises a first polypeptide and a second polypeptide. In some embodiments, a first polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of SEQ ID NO: 1023-1289, 1311-1329, and 1334-1336. In some embodiments, a second polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of SEQ ID NO: 1023-1289, 1311-1329, and 1334-1336. In some embodiments, a dimer molecule comprises a first polypeptide comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of SEQ ID NO: 1023-1289, 1311-1329, and 1334-1336; and a second polypeptide comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of SEQ ID NO: 1023-1289, 1311-1329, and 1334-1336.

In some embodiments, a dimer molecule comprises a first polypeptide and a second polypeptide. In some embodiments, a first polypeptide comprises an amino acid sequence of any one sequence of SEQ ID NO: 1023-1289, 1311-1329, and 1334-1336. In some embodiments, a second polypeptide comprises an amino acid sequence of any one sequence of SEQ ID NO: 1023-1289, 1311-1329, and 1334-1336. In some embodiments, a dimer molecule comprises a first polypeptide comprising an amino acid sequence of any one sequence of SEQ ID NO: 1023-1289, 1311-1329, and 1334-1336; and a second polypeptide comprising an amino acid sequence of any one sequence of SEQ ID NO: 1023-1289, 1311-1329, and 1334-1336.

In some embodiments, a dimer molecule comprises a first polypeptide and a second polypeptide. In some embodiments, a first polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316. In some embodiments, a second polypeptide comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT- 208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316. In some embodiments, a dimer molecule comprises a first polypeptide comprising an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99%, or 100% sequence identity to any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316.

In some embodiments, a dimer molecule comprises a first polypeptide and a second polypeptide. In some embodiments, a first polypeptide comprises an amino acid sequence of any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316.

In some embodiments, a dimer molecule comprises a first polypeptide comprising an amino acid sequence of any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316; and a second polypeptide comprising an amino acid sequence of any one sequence of VRT-1, VRT-2, VRT-3, VRT-4, VRT-5, VRT-6, VRT-7, VRT-8, VRT-9, VRT-10, VRT-11, VRT-12, VRT-13, VRT-14, VRT-15, VRT-16, VRT-17, VRT-18, VRT-19, VRT-20, VRT-21, VRT-22, VRT-23, VRT-24, VRT-25, VRT-26, VRT-27, VRT-28, VRT-29, VRT-30, VRT-31, VRT-32, VRT-33, VRT-34, VRT-35, VRT-36, VRT-37, VRT-38, VRT-39, VRT-40, VRT-41, VRT-42, VRT-43, VRT-44, VRT-45, VRT-46, VRT-47, VRT-48, VRT-49, VRT-50, VRT-51, VRT-52, VRT-53, VRT-54, VRT-55, VRT-56, VRT-57, VRT-58, VRT-59, VRT-60, VRT-61, VRT-62, VRT-63, VRT-64, VRT-65, VRT-66, VRT-67, VRT-68, VRT-69, VRT-70, VRT-71, VRT-72, VRT-73, VRT-74, VRT-75, VRT-76, VRT-77, VRT-78, VRT-79, VRT-80, VRT-81, VRT-82, VRT-83, VRT-84, VRT-85, VRT-86, VRT-87, VRT-88, VRT-89, VRT-90, VRT-91, VRT-92, VRT-93, VRT-94, VRT-95, VRT-96, VRT-97, VRT-98, VRT-99, VRT-100, VRT-101, VRT-102, VRT-103, VRT-104, VRT-105, VRT-106, VRT-107, VRT-108, VRT-109, VRT-110, VRT-111, VRT-112, VRT-113, VRT-114, VRT-115, VRT-16, VRT-117, VRT-118, VRT-119, VRT-120, VRT-121, VRT-122, VRT-123, VRT-124, VRT-125, VRT-126, VRT-127, VRT-128, VRT-129, VRT-130, VRT-131, VRT-132, VRT-133, VRT-134, VRT-135, VRT-136, VRT-137, VRT-138, VRT-139, VRT-140, VRT-141, VRT-142, VRT-143, VRT-144, VRT-145, VRT-146, VRT-147, VRT-148, VRT-149, VRT-150, VRT-151, VRT-152, VRT-153, VRT-154, VRT-155, VRT-156, VRT-157, VRT-158, VRT-159, VRT-160, VRT-161, VRT-162, VRT-163, VRT-164, VRT-165, VRT-166, VRT-167, VRT-168, VRT-169, VRT-170, VRT-171, VRT-172, VRT-173, VRT-174, VRT-175, VRT-176, VRT-177, VRT-178, VRT-179, VRT-180, VRT-181, VRT-182, VRT-183, VRT-184, VRT-185, VRT-186, VRT-187, VRT-188, VRT-189, VRT-190, VRT-191, VRT-192, VRT-193, VRT-194, VRT-195, VRT-196, VRT-197, VRT-198, VRT-199, VRT-200, VRT-201, VRT-202, VRT-203, VRT-204, VRT-205, VRT-206, VRT-207, VRT-208, VRT-209, VRT-210, VRT-211, VRT-212, VRT-213, VRT-214, VRT-215, VRT-216, VRT-217, VRT-218, VRT-219, VRT-220, VRT-221, VRT-222, VRT-223, VRT-224, VRT-225, VRT-226, VRT-227, VRT-228, VRT-229, VRT-230, VRT-231, VRT-232, VRT-233, VRT-234, VRT-235, VRT-236, VRT-237, VRT-238, VRT-239, VRT-240, VRT-241, VRT-242, VRT-243, VRT-244, VRT-245, VRT-246, VRT-247, VRT-248, VRT-249, VRT-250, VRT-251, VRT-252, VRT-253, VRT-254, VRT-255, VRT-256, VRT-257, VRT-258, VRT-259, VRT-260, VRT-261, VRT-262, VRT-263, VRT-264, VRT-265, VRT-266, VRT-267, VRT-268, VRT-269, VRT-270, VRT-271, VRT-272, VRT-273, VRT-274, VRT-275, VRT-276, VRT-277, VRT-278, VRT-279, VRT-280, VRT-281, VRT-282, VRT-283, VRT-284, VRT-285, VRT-286, VRT-287, VRT-289, VRT-290, VRT-291, VRT-292, VRT-293, VRT-294, VRT-295, VRT-296, VRT-297, VRT-298, VRT-299, VRT-300, VRT-301, VRT-302, VRT-303, VRT-304, VRT-305, VRT-306, VRT-307, VRT-308, VRT-309, VRT-310, VRT-311, VRT-312, VRT-313, VRT-314, VRT-315, or VRT-316.

In some embodiments, the dimer is a homodimer molecule. In some embodiments, the dimer is a heterodimer molecule.

As used herein, the term "non-covalently conjugated" can mean that a polypeptide is tethered to another polypeptide through a linker. In some embodiments, the linker is a peptide linker. Non-limiting examples of peptide linkers that can be used are known in the art and are provide for herein.

As discussed herein the different domains, molecules, or polypeptide can be linked together with a linker domain or region. Any linker region described herein can be used as a linker. Linkers can be for example, glycine/serine linkers. In some embodiments, the linker can comprise one or more repeats of GGGGS (SEQ ID NO: 1337). In some embodiments, the linker comprises 1, 2, 3, 4, or 5 repeats. In some embodiments, the linker comprises the sequence of GGGGSGGGGS (SEQ ID NO: 1338). In some embodiments, the linker comprises the sequence of GGGGSGGGGSGGGGS (SEQ ID NO: 1339). In some embodiments, the linker comprises the sequence of GGGGSGGGGSGGGGSG (SEQ ID NO: 1020). In some embodiments, the linker comprises the sequence of GGGGSGGGGSGGGGSGGGGSG (SEQ ID NO: 1021). In some embodiments, the linker comprises the sequence of GGGGSGGGGSG (SEQ ID NO: 1022). In some embodiments, the linker comprises: GGGGS (SEQ ID NO: 1337), (GGGGS)$_3$ (SEQ ID NO: 1339), (GGGGS)$_n$ (n=1, 2, 3, 4) (SEQ ID NO: 1337, SEQ ID NO: 1338, SEQ ID NO: 1339, SEQ ID NO: 1340, respectively), (Gly)$_8$ (SEQ ID NO: 1341), (Gly)$_6$ (SEQ ID NO: 1342), (EAAAK)$_3$ (SEQ ID NO: 1343), (EAAK)$_n$ (n=1-3) (SEQ ID NO: 1344, SEQ ID NO: 1345, SEQ ID NO: 1346, respectively), A(EAAAK)$_4$ALEA (EAAAK)4A (SEQ ID NO: 1347), or AEAAAKEAAAKA (SEQ ID NO: 1348). These linkers can be used in any of the compounds or compositions provided herein.

Antibody molecule, as that term is used herein, refers to a polypeptide, e.g., an immunoglobulin chain or fragment thereof, comprising at least one functional immunoglobulin variable domain sequence. An antibody molecule encompasses antibodies (e.g., full-length antibodies) and antibody fragments. In some embodiments, an antibody molecule comprises an antigen binding or functional fragment of a full length antibody, or a full length immunoglobulin chain. For example, a full-length antibody is an immunoglobulin (Ig) molecule (e.g., an IgG antibody) that is naturally occurring or formed by normal immunoglobulin gene fragment recombinatorial processes). In embodiments, an antibody molecule refers to an immunologically active, antigen-binding portion of an immunoglobulin molecule, such as an antibody fragment. An antibody fragment, e.g., functional fragment, comprises a portion of an antibody, e.g., Fab, Fab', F(ab')2, F(ab)2, variable fragment (Fv), domain antibody (dAb), or single chain variable fragment (scFv). A functional antibody fragment binds to the same antigen as that recognized by the intact (e.g., full-length) antibody. The terms "antibody fragment" or "functional fragment" also include isolated fragments consisting of the variable regions, such as the "Fv" fragments consisting of the variable regions of the heavy and light chains or recombinant single chain polypeptide molecules in which light and heavy variable regions are connected by a peptide linker ("scFv proteins"). In some embodiments, an antibody fragment does not include portions of antibodies without antigen binding activity, such as Fc fragments or single amino acid residues. Exemplary antibody molecules include full length antibodies and antibody fragments, e.g., dAb (domain antibody), single chain, Fab, Fab', and F(ab')2 fragments, and single chain variable fragments (scFvs).

The term "antibody molecule" also encompasses whole or antigen binding fragments of domain, or single domain, antibodies, which can also be referred to as "sdAb" or "VHH." Domain antibodies comprise either $V_H$ or $V_L$ that can act as stand-alone, antibody fragments. Additionally, domain antibodies include heavy-chain-only antibodies (HCAbs). Domain antibodies also include a CH2 domain of an IgG as the base scaffold into which CDR loops are grafted. It can also be generally defined as a polypeptide or protein comprising an amino acid sequence that is comprised of four framework regions interrupted by three complementarity determining regions. This is represented as FP1-CDP1-FR2-CDR2-FN1-CDN1-FR4. sdAbs can be produced in camelids such as llamas, but can also be synthetically generated using techniques that are well known in the art. The numbering of the amino acid residues of a sdAb or polypeptide is according to the general numbering for VH domains given by Kabat et al. ("Sequence of proteins of immunological interest," US Public Health Services, NIH Bethesda, MD, Publication No. 91, which is hereby incorporated by reference). According to this numbering, FP1 of a sdAb comprises the amino acid residues at positions 1-30, CDP1 of a sdAb comprises the amino acid residues at positions 31-36, FR2 of a sdAb comprises the amino acids at positions 36-49, CDR2 of a sdAb comprises the amino acid residues at positions 50-65, FN1 of a sdAb comprises the amino acid residues at positions 66-94, CDN1 of a sdAb comprises the amino acid residues at positions 95-102, and FR4 of a sdAb comprises the amino acid residues at positions 103-113. Domain antibodies are also described in WO2004041862 and WO2016065323, each of which is hereby incorporated by reference. The domain antibodies can be a targeting moiety as described herein.

Antibody molecules can be monospecific (e.g., monovalent or bivalent), bispecific (e.g., bivalent, trivalent, tetravalent, pentavalent, or hexavalent), trispecific (e.g., trivalent, tetravalent, pentavalent, hexavalent), or with higher orders of specificity (e.g, tetraspecific) and/or higher orders of valency beyond hexavalency. An antibody molecule can comprise a functional fragment of a light chain variable region and a functional fragment of a heavy chain variable region, or heavy and light chains may be fused together into a single polypeptide. Effector, as that term is used herein, refers to an entity, e.g., a cell or molecule, e.g., a soluble or cell surface molecule, which mediates an immune response. In some embodiments, the effector is an antibody. In some embodiments, the effectors binding domains as provided for herein, refers to a polypeptide (e.g.) that has sufficient binding specificity that it can bind the effector with sufficient specificity that it can serve as an effector binding/modulating molecule. In some embodiments, it binds to effector with at least 10, 20, 30, 40, 50, 60, 70, 80, 90, or 95% of the affinity of the naturally occurring counter-ligand. In some embodiments, it has at least 60, 70, 80, 90, 95, 99, or 100% sequence identity, or substantial sequence identity, with a naturally occurring counter-ligand for the effector.

Elevated risk, as used herein, refers to the risk of a disorder in a subject, wherein the subject has one or more of a medical history of the disorder or a symptom of the disorder, a biomarker associated with the disorder or a symptom of the disorder, or a family history of the disorder or a symptom of the disorder.

The domains can have similarity to those as provided for herein or those that are incorporated by reference. Sequence identity, percentage identity, and related terms, as those terms are used herein, refer to the relatedness of two sequences, e.g., two nucleic acid sequences or two amino acid or polypeptide sequences. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 85%, 90%, 91%, 92%, 93%, 94%, 95%, 96%, 97%, 98% or 99% identity to a reference sequence, e.g., an amino acid sequence provided herein.

In the context of nucleotide sequence, such as those encoding for the domains, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 85%, 90%, 91%, 92%, 93%, 94%, 95%, 96%, 97%, 98% or 99% identity to a reference sequence, e.g., an amino acid sequence provided herein.

The term "functional variant" refers to polypeptides that have a substantially identical amino acid sequence to the naturally-occurring sequence, or are encoded by a substantially identical nucleotide sequence, and are capable of having one or more activities of the naturally-occurring sequence. For example, a Fc variant can have the amino acid sequence of a Fc polypeptide but comprise a mutation that prevents or disrupts cleavage by a protease.

Calculations of homology or sequence identity between sequences (the terms are used interchangeably herein) can be performed as follows.

To determine the percent identity of two amino acid sequences, or of two nucleic acid sequences, the amino acid sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology").

The percent identity between the two sequences is a function of the number of identical positions shared by the amino acid sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) J. Mol. Biol. 48:444-453) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) J. Mol. Biol. 215: 403-10. BLAST nucleotide searches can be performed with the NBLAST program, score=100, wordlength=12 to obtain nucleotide sequences homologous to for example any a nucleic acid sequence provided herein. BLAST protein searches can be performed with the XBLAST program, score=50, wordlength=3 to obtain amino acid sequences homologous to protein molecules provided herein. To obtain gapped alignments for comparison purposes, Gapped BLAST can be utilized as described in Altschul et al., (1997) Nucleic Acids Res. 25:3389-3402. When utilizing BLAST and Gapped BLAST programs, the default parameters of the respective programs (e.g., XBLAST and NBLAST) can be used. See http://www.ncbi.nlm.nih.gov.

As used herein, the term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified.

It is understood that the molecules of the present embodiments may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The molecules and polypeptides provided for herein can be used to treat diseases and conditions mediated by IgG. Thus, embodiments are provided for methods of treating an IgG mediated disease or disorder in a subject. In some embodiments, the IgG mediated disease or disorder is an autoimmune disease or disorder. In some embodiments, the methods comprise administering to the subject a polypeptide, molecule, compound, or compositions as provided for herein. In some embodiments, the subject has or is at risk of having an IgG mediated disease or disorder. In some embodiments, the subject has or is at risk of having an autoimmune disease or disorder.

Antibody-mediated rejection (AMR) causes severe and rapid dysfunction and loss of allografts. Without wishing to be bound to a particular theory, the most common mechanism underlying AMR is an anamnestic response that originates from previous antigenic exposure. These donor specific antibody (DSA) responses are usually robust and result in the rapid production of high levels of DSA and acute allograft dysfunction. The mechanism of injury in AMR involves antigens that initiate the production of DSAs resulting in antigen-antibody interactions, complement activation and inflammation, and the resultant donor tissue damage. The impact of AMR on graft survival is dramatic and continues long after the initial inflammatory condition has resolved as was recently demonstrated in a study by LeFaucheur and Glotz. In this single center study of a large cohort of sensitized recipients, the investigators compared allograft survival for recipients successfully treated for AMR versus those that never experienced AMR. In some embodiments, the molecules and polypeptides provided for herein can be used to treat AMR.

In some embodiments, methods of treating a disease or disorder in a subject are provided. In some embodiments, the disease or disorder is an Ig mediated disease or disorder. In some embodiments, the disease or disorder is an autoimmune disease or disorder.

In some embodiments, methods of decreasing circulating immunoglobulins in a subject are provided. In some embodiments, the circulating immunoglobulins are selected from IgG (such as IgG1, IgG2, IgG3, IgG4), IgA, IgM, IgE, or IgD. In some embodiments, methods of decreasing circulating IgG immunoglobulins are provided. In some embodiments, methods of decreasing circulating IgG1 immunoglobulins are provided. In some embodiments, methods of decreasing circulating IgG2 immunoglobulins are provided. In some embodiments, methods of decreasing circulating IgG3 immunoglobulins are provided. In some embodiments, methods of decreasing circulating IgG4 immunoglobulins are provided. In some embodiments, methods of decreasing circulating IgA immunoglobulins are provided. In some embodiments, methods of decreasing circulating IgM immunoglobulins are provided. In some embodiments, methods of decreasing circulating IgE immunoglobulins are provided. In some embodiments, methods of decreasing circulating IgD immunoglobulins are provided. In some embodiments, methods of decreasing circulating immunoglobulins in a subject are provided, wherein the subject is a subject with an autoimmune disease or disorder.

In some embodiments, a method of reducing immunoglobulins is provided. In some embodiments, a method of reducing immunoglobulins, such as IgG, in a subject, is provided. In some embodiments, the method of reducing immunoglobulins, such as IgG, in a subject, comprises administering to the subject any one of the polypeptides or compositions provided for herein. In some embodiments, the method of reducing immunoglobulins, such as IgG, in a subject, comprises administering to the subject the polypeptide comprising the amino acid sequence of any one of SEQ ID NO: 55-1019, 1023-1329, and 1333-1336 or the composition thereof. In some embodiments, the reduction of immunoglobulins may be about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100% reduction. In some embodiments, the reduction of immunoglobulins may be at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction. In some embodiments, the reduction of immunoglobulins may be a 5%, 10%, 15%, 20%, 25%, 30%, 35%, 40%, 45%, 50%, 55%, 60%, 65%, 70%, 75%, 80%, 85%, 90%, 95%, or 100% reduction.

In some embodiments, a method of treating a disease or disorder in a subject is provided. In some embodiments, the method of treating a disease or disorder in a subject, comprises administering to the subject any one of the polypeptides or compositions provided for herein. In some embodiments, the method of treating a disease or disorder in a subject comprises administering to the subject the polypeptide comprising the amino acid sequence of any one of SEQ ID NO: 55-1019, 1023-1329, and 1333-1336 or the composition thereof.

In some embodiments, a method of treating a transplant subject is provided. In some embodiments, the method of treating a transplant subject comprises administering to the subject any one of the polypeptides or compositions provided for herein. In some embodiments, the method of treating a transplant subject comprises administering to the subject the polypeptide comprising the amino acid sequence of any one of SEQ ID NO: 55-1019, 1023-1329, and 1333-1336 or the composition thereof.

In some embodiments, a method of improving a gene-therapy in subject is provided. In some embodiments, the method of improving a gene-therapy in subject comprises administering to the subject any one of the polypeptides or compositions provided for herein. In some embodiments, the method of improving a gene-therapy in subject comprises administering to the subject the polypeptide comprising the amino acid sequence of any one of SEQ ID NO: 55-1019, 1023-1329, and 1333-1336 or the composition thereof.

In some embodiments, a method of treating a subject having, or at risk, or elevated risk, for having, an IgG mediated disease or disorder is provided. In some embodiments, the method of treating a subject having, or at risk, or elevated risk, for having, an IgG mediated disease or disorder comprises administering to the subject any one of the polypeptides or compositions provided for herein. In some embodiments, the method of treating a subject having, or at risk, or elevated risk, for having, an IgG mediated disease or disorder comprises administering to the subject the polypeptide comprising the amino acid sequence of any one of SEQ ID NO: 55-1019, 1023-1329, and 1333-1336 or the composition thereof.

In some embodiments, a method of cleaving B cell receptor in a subject is provided. In some embodiments, the method of cleaving B cell receptor in a subject comprises administering to the subject any one of the polypeptides or compositions provided for herein. In some embodiments, the method of cleaving B cell receptor in a subject comprises administering to the subject the polypeptide comprising the amino acid sequence of any one of SEQ ID NO: 55-1019, 1023-1329, and 1333-1336 or the composition thereof.

Non-limiting examples of diseases and disorders, such as autoimmune diseases or disorders, that can be treated with the molecules and polypeptides described herein include, but are not limited to, Addison's disease, Anti-GBM glomerulonephritis, anti-neutrophil cytoplasmic antibody-associated vasculitides, ANCA associated vasculitis, granulomatous polyangiitis (Wegener granulomatosis), eosinophilic granulomatosis with polyangiitis (Churg-Strauss syndrome), microscopic polyangiitis, anti-NMDAR encephalitis, antiphospholipid antibody syndrome (APS) and catastrophic APS, autoimmune bullous skin diseases, pemphigus, pemphigus foliaceus (PF), fogo selvage (FS), pemphigus vulgaris (PV), autoimmune hemolytic anemia (AIHA), autoimmune hepatitis (AIH), autoimmune neutropenia (AIN), bullous pemphigoid (BP), Celiac's disease, chronic urticaria, complete congenital heart block (CCHB), diabetes type 1A (T1DM), epidermolysis bullosa acquisita (EBA), essential mixed cryoglobulinemia, Goodpasture's syndrome, anti-glomerular basement membrane disease, Graves' disease, Goitre, hyperthyroidism, infiltrative exophthalmos, infiltrative dermopathy, Guillain-Barre syndrome (GBS), acute inflammatory demyelinating polyneuropathy (AIDP), acute motor axonal neuropathy (AMAN), hemophilia, acquired FVII deficiency, idiopathic thrombocytopenic purpura (ITP), Lambert-Eaton myasthenic syndrome (LEMS), mixed connective tissue disease (MCTD), multiple myeloma, myasthenia gravis, myasthenic crisis, myocarditis, dilated cardiomyopathy (DCM), congestive cardiomyopathy, neuromyelitis optica (NMO), primary biliary cirrhosis (PBC), primary progressive multiple sclerosis (PPMS), relapsing-rheumatic multiple sclerosis, acute exacerbation of multiple sclerosis, rheumatic heart disease (RHD), rheumatoid arthritis (RA), serum-sickness, immune complex hypersensitivity (type III), Sjögren's syndrome (SS), lupus nephritis, systemic lupus erythematosus (SLE), cutaneous lupus (CLE), transplant rejection, thrombotic thrombocytopenic purpura (TTP), idiopathic inflammatory myopathies, polymyositis, dermatomyositis, inclusion body myositis, uveitis, scleritis, ankylosing spondylitis, axial spondyloarthritis, reactive arthritis, psoriatic arthritis, IBD-associated arthritis, antiphospholipid syndrome, systemic sclerosis, giant cell arteritis, polymyalgia rheumatic, Takayasu's arteritis, anti-neutrophil cytoplasmic antibody associated vasculitis, Henoch-Schonlein purpura, polyarteritis nodosa, Cogan's syndrome, Buerger's disease, Susan's disease, immune complex vasculitis, primary angiitis of the central nervous system (CNS), Behcet's disease, relapsing polychondritis, juvenile idiopathic arthritis, juvenile dermatomyositis, autoimmune brain disease, sarcoidosis, neurosarcoidosis, IgG4-related diseases, autoimmune complications of immune checkpoint inhibitors (IRAEs), adult onset Still's disease, warm antibody hemolytic anemia (wAIHA), immune thrombocytopenia, immune thrombotic thrombocytopenia, thrombic thrombocytopenia, pernicious anemia, aplastic anemia, Evan's syndrome, autoimmune neutropenia, acquired von Willibrand syndrome, recurring fetal loss, Rh mismatch, ulcerative colitis, autoimmune hepatitis, autoimmune pancreatitis, eosinophilic esophagitis/gastritis, primary sclerosing cholangitis, primary biliary sclerosis, glomerulonephritis, glomerular basement membrane disease, scleritis/episcleritis, uveitis, conjunctivitis, keratitis, type I diabetes mellitus, Hashimoto's thyroiditis, polyglandular autoimmune endocrine syndromes, atopic dermatitis, dermatitis herpetiformis, pemphigus foliaceus, fogo selvagem, cutaneous lupus erythematosus, linear IgA disease, Lichen planus, transplantation, antibody-mediated rejection, alloantibody hypersensitization, xenoantibody mediated rejection, solid organ rejection, graft vs. host disease (GVHD), multiple sclerosis, neuromyelitis optica, amyotrophic lateral sclerosis, Parkinson's disease, autoimmune encephalitis, CNS vasculitis, chronic idiopathic demyletinating polyneuropathy, transverse myelitis, optic neuritis, anti-myelin oligodendrocyte glycoprotein (MOG) disease, chronic meningitis, rheumatic heart disease, infectious disease, vaccination, antibody dependent enhancement, antibody to therapeutic biologic agents (cytokines, monoclonal antibodies, enzymes, coagulation factors), allergic asthma, eosinophilic pneumonia, nonspecific interstitial pneumonia, rheumatoid arthritis-associated interstitial lung disease (RA-ILD), sarcoidosis, hypersensitive pneumonitis, allergic bronchopulmonary mycosis, chronic rhinosinusitis with nasal polyps, and the like.

In some embodiments, methods of treating a transplant subject are provided. In some embodiments, methods of improving a gene-therapy in a subject are provided. In some embodiments, methods of treating a subject having, or at risk, or elevated risk, for having, an IgG mediated disease or disorder are provided.

In some embodiments, methods comprise administering a therapeutically effective amount of any one of the polypeptides provided herein, or the pharmaceutical composition comprising any one polypeptide provided herein, thereby treating the subject.

In some embodiments, the condition or disease to be treated is a neoplastic disorder, such as a cancer. In some embodiments, the cancer is a solid or liquid tumor. In some embodiments, the liquid or solid tumor include, but are not limited to, hematopoietic cancer, lymphoid cancer, skin cancer, head and neck cancer, genitourinary cancer, blood cancer, lung cancer, breast cancer, brain cancer, esophageal cancer, colorectal cancer, pancreatic cancer, and any combination thereof.

Pharmaceutical Compositions and Kits

In some embodiments, the present embodiments provide compositions, e.g., pharmaceutically acceptable compositions, which include a therapeutic compound described herein, formulated together with a pharmaceutically acceptable carrier. As used herein, "pharmaceutically acceptable carrier" includes any and all solvents, dispersion media, isotonic and absorption delaying agents, and the like that are physiologically compatible.

The carrier can be suitable for intravenous, intramuscular, subcutaneous, parenteral, rectal, local, ophthalmic, topical, spinal or epidermal administration (e.g. by injection or infusion). As used herein, the term "carrier" means a diluent, adjuvant, or excipient with which a compound is administered. In some embodiments, pharmaceutical carriers can also be liquids, such as water and oils, including those of petroleum, animal, vegetable or synthetic origin, such as peanut oil, soybean oil, mineral oil, sesame oil and the like. The pharmaceutical carriers can also be saline, gum acacia, gelatin, starch paste, talc, keratin, colloidal silica, urea, and the like. In addition, auxiliary, stabilizing, thickening, lubricating and coloring agents can be used. The carriers can be used in pharmaceutical compositions comprising the therapeutic compounds provided for herein.

The compositions and compounds of the embodiments provided for herein may be in a variety of forms. These include, for example, liquid, semi-solid and solid dosage forms, such as liquid solutions (e.g., injectable and infusible solutions), dispersions or suspensions, liposomes and suppositories. The preferred form depends on the intended mode of administration and therapeutic application. Typical compositions are in the form of injectable or infusible solutions. In some embodiments, the mode of administration is parenteral (e.g., intravenous, subcutaneous, intraperitoneal, intramuscular). In some embodiments, the therapeutic molecule is administered by intravenous infusion or injection. In another embodiment, the therapeutic molecule is administered by intramuscular or subcutaneous injection. In another embodiment, the therapeutic molecule is administered locally, e.g., by injection, or topical application, to a target site.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The compositions typically should be sterile and stable under the conditions of manufacture and storage. The composition can be formulated as a solution, microemulsion, dispersion, liposome, or other ordered structure suitable to high therapeutic molecule concentration. Sterile injectable solutions can be prepared by incorporating the active compound (i.e., therapeutic molecule) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

In certain embodiments, a therapeutic compound can be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation. Therapeutic compositions can also be administered with medical devices known in the art.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms are dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of a therapeutic compound is 0.1-30 mg/kg, more preferably 1-25 mg/kg. Dosages and therapeutic regimens of the therapeutic compound can be determined by a skilled artisan. In certain embodiments, the therapeutic compound is administered by injection (e.g., subcutaneously or intravenously) at a dose of about 1 to 40 mg/kg, e.g., 1 to 30 mg/kg, e.g., about 5 to 25 mg/kg, about 10 to 20 mg/kg, about 1 to 5 mg/kg, 1 to 10 mg/kg, 5 to 15 mg/kg, 10 to 20 mg/kg, 15 to 25 mg/kg, or about 3 mg/kg. The dosing schedule can vary from e.g., once a week to once every 2, 3, or 4 weeks. In one embodiment, the therapeutic compound is administered at a dose from about 10 to 20 mg/kg every other week. The therapeutic compound can be administered by intravenous infusion at a rate of more than 20 mg/min, e.g., 20-40 mg/min, and typically greater than or equal to 40 mg/min to reach a dose of about 35 to 440 mg/m$^2$, typically about 70 to 310 mg/m$^2$, and more typically, about 110 to 130 mg/m$^2$. In embodiments, the infusion rate of about 110 to 130 mg/m$^2$ achieves a level of about 3 mg/kg. In other embodiments, the therapeutic compound can be administered by intravenous infusion at a rate of less than 10 mg/min, e.g., less than or equal to 5 mg/min to reach a dose of about 1 to 100 mg/m$^2$, e.g., about 5 to 50 mg/m$^2$, about 7 to 25 mg/m$^2$, or, about 10 mg/m$^2$. In some embodiments, the therapeutic compound is infused over a period of about 30 min. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

The pharmaceutical compositions may include a "therapeutically effective amount" or a "prophylactically effective amount" of a therapeutic molecule. A "therapeutically effective amount" refers to an amount effective, at dosages and for periods of time necessary, to achieve the desired therapeutic result. A therapeutically effective amount of a therapeutic molecule may vary according to factors such as the disease state, age, sex, and weight of the individual, and the ability of the therapeutic compound to elicit a desired response in the individual. A therapeutically effective amount is also one in which any toxic or detrimental effects of a therapeutic molecule is outweighed by the therapeutically beneficial effects. A "therapeutically effective dosage" preferably inhibits a measurable parameter, e.g., immune attack at least about 20%, more preferably by at least about 40%, even more preferably by at least about 60%, and still more preferably by at least about 80% relative to untreated subjects. The ability of a compound to inhibit a measurable parameter, e.g., immune attack, can be evaluated in an animal model system predictive of efficacy in transplant rejection or autoimmune disorders. Alternatively, this property of a composition can be evaluated by examining the ability of the compound to inhibit, such inhibition in vitro by assays known to the skilled practitioner.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

B-cell receptors (BCRs) are crucial elements of the adaptive immune system and are expressed on the surface of B cells (Xie, W., Wucherpfennig, K. & Patel, D. J. A structural platform for B cell receptor signaling. Cell Res 33, 95-96 (2023). https://doi.org/10.1038/s41422-022-00724-9). These receptors are responsible for recognizing and binding antigens. Without wishing to be bound by a particular theory, B-cell receptors are composed of two heavy chains and two light chains forming an antigen-binding fragment (Fab). This Fab region is responsible for recognizing and binding specific antigens. Attached to the Fab fragment is the constant region, composed of the remainder of the two heavy chains. The constant region spans the B cell membrane and includes a short intracellular segment that signals the B cell when an antigen is bound. When a BCR binds to an antigen, the B cell engulfs the antigen and presents fragments of it on the cell surface using a molecule called major histocompatibility complex II (MHC II). This action attracts a type of T cell called a helper T cell, which binds to the antigen fragment and the MHC II molecule. The binding of the helper T cell releases substances that stimulate the B cell to divide and differentiate into memory B cells and plasma cells. The plasma cells produce and secrete large amounts of the BCR in a form called an antibody that can travel throughout the body in the blood, binding to antigens and marking them for destruction.

The BCR can be cleaved to yield a soluble form. The cleavage product of a BCR is an antibody. In some embodiments, the cleavage product of a BCR which is an antibody, marks antigens for destruction by phagocytes, natural killer cells, or the complement system. Thus, in some embodiments, methods of cleaving a B cell receptor are provided. In some embodiments, the method comprises administering a therapeutically effective amount of any one polypeptide provided herein, or the pharmaceutical composition thereof, to cleave the B cell receptor. In some embodiments, the polypeptide is administered to a cell, a tissue, an animal, or a subject. In some embodiments, the cell, the tissue, the animal, or the subject is any cell, tissue, animal, or subject.

In some embodiments, the polypeptide having IgG protease activity, such as those provided herein, may be administered to a subject. In some embodiments, the polypeptide having IgG protease activity, such as those provided herein, may be administered to a subject in need thereof. In some embodiments, the polypeptide having IgG protease activity, such as those provided herein, may be administered more than once (e.g., two times, three times, four times, five times, or more). In some embodiments, the polypeptide having IgG protease activity, such as those provided herein, may be administered at least once, at least twice, at least three time, at least four times, or more. In some embodiments, the polypeptide having IgG protease activity, such as those provided herein, may be administered to a subject without inducing an immune response from the subject. In some embodiments, the polypeptide having IgG protease activity, such as those provided herein, does not induce an immune response from a subject after administration to the subject. In some embodiments, the polypeptide having IgG protease activity, such as those provided herein, may be administered to a subject more than once without inducing an immune response from the subject.

Also within the scope of the embodiments is a kit comprising a therapeutic compound described herein. The kit can include one or more other elements including: instructions for use; other reagents, e.g., a label, a therapeutic agent, or an agent useful for chelating, or otherwise coupling, a therapeutic molecule to a label or other therapeutic agent, or a radioprotective composition; devices or other materials for preparing the a therapeutic molecule for administration; pharmaceutically acceptable carriers; and devices or other materials for administration to a subject.

In some embodiments, a pharmaceutical composition comprising any one of the polypeptides provided herein is provided. In some embodiments, the composition comprises a dimer comprising a first polypeptide comprising any one of the polypeptides provided herein and a second polypeptide comprising any one of the polypeptides provided herein, wherein the first polypeptide and the second polypeptide are the same. In some embodiments, the composition comprises a dimer comprising a first polypeptide comprising any one of the polypeptides provided herein linked to a first protease resistant Fc domain, and a second polypeptide comprising any one of the polypeptides provided herein linked to a second protease resistant Fc domain, wherein the first polypeptide and the second polypeptide are the same. In some embodiments, the first protease resistant Fc domain and the second protease resistant Fc domain comprise the same amino acid sequence. In some embodiments, the first protease resistant Fc domain and the second protease resistant Fc domain comprise different amino acid sequences, provided that the first and second Fc domains can form a dimer. In some embodiments, the first and second protease resistant Fc domains comprise, independently, the amino acid sequence of any one of SEQ ID NOs: 19, 20, 21, 22, 23, 24, 25, 42, 43, 44, 45, 46, 47, 48, or 49. In some embodiments, the protease resistant Fc domain comprises the amino acid sequence of SEQ ID NO: 23.

A protease or a polypeptide provided for herein may be produced by any suitable means. For example, the protease or the polypeptide may be synthesized directly using standard techniques known in the art.

As used herein, the terms "nucleic acid molecule" and "polynucleotide" may be used interchangeably and refer to a polymeric form of nucleotides of any length, either deoxyribonucleotides or ribonucleotides, or analogs thereof. Non-limiting examples of polynucleotides include a gene, a gene fragment, messenger RNA (mRNA), cDNA, recombinant polynucleotides, plasmids, vectors, isolated DNA of any sequence, isolated RNA of any sequence, nucleic acid probes, and primers. A polynucleotide of the disclosure may be provided in isolated or substantially isolated form. By substantially isolated, it is meant that there may be substantial, but not total, isolation of the polypeptide from any surrounding medium. The polynucleotides may be mixed with carriers or diluents which will not interfere with their intended use and still be regarded as substantially isolated. A nucleic acid sequence which "encodes" a selected polypeptide is a nucleic acid molecule which is transcribed (in the case of DNA) and translated (in the case of mRNA) into a polypeptide in vivo when placed under the control of appropriate regulatory sequences. The boundaries of the coding sequence are determined by a start codon at the 5' (N-) terminus and a translation stop codon at the 3' (C-) terminus. For the purposes of the disclosure, such nucleic acid sequences can include, but are not limited to, cDNA from viral, prokaryotic or eukaryotic mRNA, genomic sequences from viral or prokaryotic DNA or RNA, and even synthetic DNA sequences. A transcription termination sequence may be located 3' to the coding sequence.

Polynucleotides encoding protease or polypeptides provided for herein may be synthesized according to methods well known in the art, as described by way of example in Sambrook et al (1989, Molecular Cloning—a laboratory manual; Cold Spring Harbor Press). The nucleic acid molecules of the present disclosure may be provided in the form of an expression cassette which includes control sequences operably linked to the inserted sequence, thus allowing for expression of the polypeptide of the disclosure in vivo. These expression cassettes, in turn, are typically provided within vectors (e.g., plasmids or recombinant viral vectors). Such an expression cassette may be administered directly to a host subject.

In some embodiments, the protease or the polypeptide provided for herein may be produced by transforming a cell, typically a bacterial cell, with a nucleic acid molecule or vector which encodes said protease or polypeptide. In some embodiments, a vector comprising a polynucleotide encoding a protease or a polypeptide provided for herein may be administered to a host subject. In some embodiments, the polynucleotide is prepared and/or administered using a vector. A suitable vector may be any vector which is capable of carrying a sufficient amount of genetic information, and allowing expression of a protease or a polypeptide of the disclosure. In some embodiments, nucleic acid molecules or a polynucleotide is provided that encodes a protease or a polypeptide as provided for herein. In some embodiments, the polynucleotide is DNA. In some embodiments, the polynucleotide is RNA, such as mRNA.

The present disclosure thus includes expression vectors that comprise such polynucleotide sequences. Such expression vectors are routinely constructed in the art of molecular biology and may for example involve the use of plasmid DNA and appropriate initiators, promoters, enhancers and other elements, such as for example polyadenylation signals which may be necessary, and which are positioned in the correct orientation, in order to allow for expression of a protease or a polypeptide of the disclosure. Other suitable vectors would be apparent to persons skilled in the art.

In some embodiments, the host subject may be a cell that has been modified to express a protease or a polypeptide provided for herein. Such cells typically include prokaryotic cells such as bacterial cells, for example E. coli. In some embodiments, the host subject may be an eukaryotic cell. In some embodiments, the cell may be cultured using routine methods to produce a polypeptide of the disclosure.

In some embodiments, a vector is provided comprising the nucleic acid molecule or polynucleotide encoding a polypeptide as provided for herein. In some embodiments, the vector is a non-viral vector. In some embodiments, the vector is a viral vector, such as, but not limited to a lentivirus, an AAV vector, an AV vector, and the like. In some embodiments, the non-viral vector is a plasmid. In some embodiments, the non-viral vector is mRNA encoding the polypeptide. In some embodiments, the mRNA is encapsulated. In some embodiments, the mRNA is encapsulated in a liposome. The mRNA can contain modified nucleotides or a modified backbone to increase the mRNA half-life.

In some embodiments, a cell is provided comprising a nucleic acid molecule encoding a polypeptide as provided for herein. In some embodiments, a cell is provide comprising a vector as provided for herein. In some embodiments, the cell is a eukaryotic cell. In some embodiments, the cell is a human cell or a yeast cell. In some embodiments, the cell is not a bacterial cell. In some embodiments, the cell is a bacterial cell or a prokaryotic cell, such as, but not limited to E. coli. In some embodiments, the cell is not E. coli. In some embodiments, the cell is not a prokaryotic cell. In some embodiments, a cell is provide comprising a vector as provided for herein.

A polypeptide may be derivatized or modified to assist with their production, isolation or purification. For example, where a protease or a polypeptide of the disclosure is produced by recombinant expression in a host cell, the sequence of the polypeptide may include an additional methionine (M) residue at the N terminus to improve expression. As another example, the protease or the polypeptide of the disclosure may be derivatized or modified by addition of a leader sequence, as provided for herein.

The amino acid sequence of a polypeptide may be modified to include non-naturally occurring amino acids, for example to increase stability. When the polypeptides are produced by synthetic means, such amino acids may be introduced during production. The polypeptides may also be modified following either synthetic or recombinant production. Polypeptides may also be produced using D-amino acids. In such cases the amino acids will be linked in reverse sequence in the C- to N-orientation. This is conventional in the art for producing such polypeptides.

In some embodiments, methods of making a polypeptide as provided for herein are provided. In some embodiments, the methods comprise culturing a cell comprising a nucleic acid molecule or polynucleotide encoding the polypeptide. In some embodiments, the cell is as provided herein, such as the cells described above. In some embodiments, the cell is cultured under conditions suitable to facilitate the expression of the polypeptide.

In some embodiments, methods of making a nucleic acid sequence encoding the polypeptide are provided. In some embodiments, the methods comprise providing a vector comprising a polynucleotide sequence encoding a polypeptide having protease activity and inserting into the vector sequence encoding a variant Fc molecule to form an amino acid sequence encoding the polypeptide; or b) providing a vector comprising sequence encoding a variant Fc molecule and inserting into the vector sequence encoding a polypeptide having protease activity to form an amino acid sequence encoding the polypeptide, thereby making an nucleic acid sequence encoding the polypeptide.

The nucleic acid molecules can be transferred into a cell to produce the polypeptide by any means or methods, such as by transfection, electroporation, transduction, and the like.

Enumerated Embodiments

1. A variant Fc polypeptide comprising an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 1, provided that the variant Fc polypeptide comprises a set of mutations selected from:

L234A, L235A, G237A, Y296Q, and P329K;
L234A, L235A, G237A, Y296Q, S298K, and P329K;
L234A, L235A, G237A, D265K, E269S, Y296Q, and P329K; or L234A, L235A, G237A, D265K, E269S, Y296Q, S298K, and P329K;
as compared to SEQ ID NO: 1.

2. The variant Fc polypeptide of embodiment 1, wherein the variant Fc polypeptide comprises a set of L234A, L235A, G237A, Y296Q, and P329K mutations, as compared to SEQ ID NO: 1.

3. The variant Fc polypeptide of embodiment 1, wherein the variant Fc polypeptide comprises a set of L234A, L235A, G237A, Y296Q, S298K, and P329K mutations, as compared to SEQ ID NO: 1.

4. The variant Fc polypeptide of embodiment 1, wherein the variant Fc polypeptide comprises a set of L234A, L235A, G237A, D265K, E269S, Y296Q, and P329K mutations, as compared to SEQ ID NO: 1.

5. The variant Fc polypeptide of embodiment 1, wherein the variant Fc polypeptide comprises a set of L234A, L235A, G237A, D265K, E269S, Y296Q, S298K, and P329K mutations, as compared to SEQ ID NO: 1.

6. The variant Fc polypeptide of any one of embodiments 1-5, wherein the variant Fc polypeptide comprises a set of mutations that prevent proteolytic cleavage.

7. The variant Fc polypeptide of any one of embodiments 1-5, wherein the variant Fc polypeptide comprises a set of mutations that prevent binding by a protease.

8. The variant Fc polypeptide of any one of embodiments 1-5, wherein the variant Fc polypeptide comprises a set of mutations that prevent proteolytic cleavage and binding by a protease.

9. A variant Fc polypeptide comprising an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, 20, 21, 22, 23, 24, or 25, provided that the variant Fc polypeptide comprises a set of mutations selected from:
L234A, L235A, G237A, Y296Q, and P329K;
L234A, L235A, G237A, Y296Q, S298K, and P329K;
L234A, L235A, G237A, D265K, E269S, Y296Q, and P329K; or
L234A, L235A, G237A, D265K, E269S, Y296Q, S298K, and P329K;
as compared to SEQ ID NO: 19, 20, 21, 22, 23, 24, or 25.

10. The variant Fc polypeptide of embodiment 9, wherein the variant IgG Fc comprises:
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, and P329K mutations, as compared to SEQ ID NO: 19;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, and P329K mutations, as compared to SEQ ID NO: 20;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, and P329K mutations, as compared to SEQ ID NO: 21;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, and P329K mutations, as compared to SEQ ID NO: 22;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, and P329K mutations, as compared to SEQ ID NO: 23;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, and P329K mutations, as compared to SEQ ID NO: 24;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, and P329K mutations, as compared to SEQ ID NO: 25;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, S298K, and P329K mutations, as compared to SEQ ID NO: 19;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, S298K, and P329K mutations, as compared to SEQ ID NO: 20;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, S298K, and P329K mutations, as compared to SEQ ID NO: 21;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, S298K, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, S298K, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, S298K, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, S298K, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, S298K, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, S298K, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, S298K, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, S298K, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, S298K, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, S298K, and P329K mutations, as compared to SEQ ID NO: 24; or an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, S298K, and P329K mutations, as compared to SEQ ID NO: 25.

11. The variant Fc polypeptide of any one of embodiments 9-10, wherein the variant Fc polypeptide comprises a set of mutations that prevent cleavage by a protease, or a variant thereof.

12. The variant Fc polypeptide of any one of embodiments 9-10, wherein the variant Fc polypeptide comprises a set of mutations that prevent binding by a protease, or a variant thereof.

13. The variant Fc polypeptide of any one of embodiments 9-12, wherein the variant Fc polypeptide comprises a set of mutations that prevent cleavage by a protease, or a variant thereof, and binding by a protease, or a variant thereof.

14. A variant Fc polypeptide comprising:
   an amino acid sequence of SEQ ID NO: 19;
   an amino acid sequence of SEQ ID NO: 21;
   an amino acid sequence of SEQ ID NO: 22;
   an amino acid sequence of SEQ ID NO: 23;
   an amino acid sequence of SEQ ID NO: 24; or
   an amino acid sequence of SEQ ID NO: 25.

15. The variant Fc polypeptide of any one of embodiments 1-14, wherein the variant Fc polypeptide is resistant to cleavage by a protease, or a variant thereof, and/or binding by a protease, or a variant thereof.

16. The variant Fc polypeptide of any one of embodiments 1-15, wherein the variant Fc polypeptide is covalently or non-covalently conjugated to a polypeptide having IgG protease activity, wherein the polypeptide having IgG protease activity can be conjugated to N-terminus or C-terminus of the variant Fc polypeptide.

17. The variant Fc polypeptide of embodiment 15, wherein the polypeptide having IgG protease activity comprises an amino acid sequence having at least 50%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 26, 28, 29, 31, 36, 37, 38, 39, 40, 41, 50, 51, 52, or 55.

18. The variant Fc polypeptide of any one of embodiments 16-17, wherein the polypeptide having IgG protease activity comprises an amino acid sequence of SEQ ID NO: 26, 28, 29, 31, 36, 37, 38, 39, 40, 41, 50, 51, 52, or 55.

19. The variant Fc polypeptide of embodiment 17, wherein the polypeptide having IgG protease activity is as effective, or more effective at cleaving IgG than the wild-type protease, and/or is less immunogenic, or as immunogenic, as the wild-type protease.

20. A polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 35, provided that the polypeptide comprises any one, or more, mutations at positions selected from: 60, 61, 63, 64, 69, 74, 76, 85, 112, 115, 116, 119, 120, 121, 130, 134, 145, 146, 154, 190, 198, 223, 225, 227, 229, 229, 231, 241, 251, 258, 273, 274, 278, 289, 303, 314, 334, and 336, as compared to SEQ ID NO: 35.

21. The polypeptide of embodiment 20, wherein the polypeptide comprises a set of mutations at positions, as compared to SEQ ID NO: 35, selected from:
   a. 60, 61, 74, and 146;
   b. 60, 61, 63, 64, 74, 76, and 146;
   c. 227, and 229;
   d. 60, 64, 69, 112, 115, 116, 119, 120, 145, 146, 198, 223, 231, 241, 251, 273, 274, 278, 303, 314, and 334;
   e. 60, 61, 63, 64, 69, 74, 76, 112, 115, 116, 119, 120, 145, 146, 198, 223, 227, 229, 231, 241, 251, 273, 274, 278, 303, 314, and 334;
   f. 225;
   g. 85, 121, 154, 190, 289, and 303;
   h. 85, 121, 154, 190, 258, 289, and 303;
   i. 134, 190, 229, 289, and 336;
   j. 130, 134, 190, 229, 289, and 336;
   k. 85, 121, 130, 134, 154, 190, 229, 289, 303, and 336;
   l. 85, 121, 134, 154, 190, 229, 289, 303, and 336;
   m. 85, 121, 130, 134, 154, 190, 229, 258, 289, and 303; or
   n. 85, 121, 134, 154, 190, 229, 258, 289, 303, and 336.

22. The polypeptide of embodiment 21, wherein the polypeptide comprises the set of mutations at positions selected from:
   60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
   60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, 336 as compared to SEQ ID NO: 35;
   60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
   60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
   60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

23. The polypeptide of any one of embodiments 20-21, wherein the polypeptide comprises any one, or more, mutations selected from A60T, N61D, T63I, Q64K, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N229E, E229N, N231T, K241Q, L251I, V258G, S273A, N274E, K278E, A289P, A303N, K314E, S334I, and N336Q, as compared to SEQ ID NO: 35.

24. The polypeptide of any one of embodiments 20-23, wherein the polypeptide comprises a set of mutations selected from:
   a. A60T, N61D, V74K, and H146S;
   b. A60T, N61D, T63I, Q64K, V74K, N76G, and H146S;
   c. F227L, and E229N;
   d. A60T, Q64Y, F69L, D112E, K115E, R116N, E119K, E120K, N145D, H146S, E198R, S223N, N231T, K241Q, L251I, S273A, N274E, K278E, A303N, K314E, and S334I;
   e. A60T, N61D, T63I, Q64Y, F69L, V74K, N76G, D112E, K115E, R116N, E119K, E120K, N145D, H146S, E198R, S223N, F227L, E229N, N231T, K241Q, L251I, S273A, N274E, K278E, A303N, K314E, and S334I;
   f. H225Y;
   g. T85L, H121Y, E154D, N190D, A289P, and N303S;
   h. T85L, H121Y, E154D, N190D, V258G, A289P, and N303S;
   i. M134L, N190D, N229E, A289P, and N336Q;
   j. N130K, M134L, N190D, N229E, A289P, and N336Q;

k. T85L, H121Y, N130K, M134L, E154D, N190D, N229E, A289P, N303S, and N336Q;

l. T85L, H121Y, M134L, E154D, N190D, N229E, A289P, N303S, and N336Q;

m. T85L, H121Y, N130K, M134L, E154D, N190D, N229E, V258G, A289P, and N303S; or n. T85L, H121Y, M134L, E154D, N190D, N229E, V258G, A289P, N303S, and N336Q.

25. The polypeptide of embodiment 23, wherein the polypeptide comprises a set of mutations selected from:

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

26. A polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 35, provided that the polypeptide comprises any one, or more, mutations at positions selected from: A60T, N61D, T63I, Q64K, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N229E, E229N, N231T, K241Q, L251I, V258G, S273A, N274E, K278E, A289P, A303N, K314E, S334I, and N336Q, as compared to SEQ ID NO: 35, wherein the polypeptide has:

a. increased stability;
b. reduced, or no binding to an anti-drug antibody;
c. increased expression in vitro;
d. no T-cell binding epitope; and/or
e. no chemical liabilities.

27. The polypeptide of embodiment 26, wherein the polypeptide comprises a set of mutations of A60T, N61D, V74K, and H146S, and wherein the polypeptide has increased stability, and/or reduced, or no binding to an anti-drug antibody.

28. The polypeptide of embodiment 26, wherein the polypeptide comprises a set of mutations of A60T, N61D, T63I, Q64K, V74K, N76G, and H146S, and wherein the polypeptide has increased stability, and/or reduced, or no binding to an anti-drug antibody.

29. The polypeptide of embodiment 26, wherein the polypeptide comprises a set of mutations of F227L, and E229N, and wherein the polypeptide has increased stability, and/or reduced, or no binding to an anti-drug antibody.

30. The polypeptide of embodiment 26, wherein the polypeptide comprises a set of mutations of A60T, Q64Y, F69L, D112E, K115E, R116N, E119K, E120K, N145D, H146S, E198R, S223N, N231T, K241Q, L251I, S273A, N274E, K278E, A303N, K314E, and S334I, and wherein the polypeptide has increased stability, and/or reduced, or no binding to an anti-drug antibody.

31. The polypeptide of embodiment 26, wherein the polypeptide comprises a set of mutations of A60T, N61D, T63I, Q64Y, F69L, V74K, N76G, D112E, K115E, R116N, E119K, E120K, N145D, H146S, E198R, S223N, F227L, E229N, N231T, K241Q, L251I, S273A, N274E, K278E, A303N, K314E, and S334I, and wherein the polypeptide has increased stability, and/or reduced, or no binding to an anti-drug antibody.

32. The polypeptide of embodiment 26, wherein the polypeptide comprises a set of mutations of H225Y, and wherein the polypeptide has increased expression in vitro.

33. The polypeptide of embodiment 26, wherein the polypeptide comprises a set of mutations of T85L, H121Y, E154D, N190D, A289P, and N303S, and wherein the polypeptide does not bind to a T-cell.

34. The polypeptide of embodiment 26, wherein the polypeptide comprises a set of mutations of T85L, H121Y, E154D, N190D, V258G, A289P, and N303S, and wherein the polypeptide does not bind to a T-cell.

35. The polypeptide of embodiment 26, wherein the polypeptide comprises a set of mutations of M134L, N190D, N229E, A289P, and N336Q, and wherein the polypeptide has no chemical liabilities.

36. The polypeptide of embodiment 26, wherein the polypeptide comprises a set of mutations of N130K, M134L, N190D, N229E, A289P, and N336Q, and wherein the polypeptide has no chemical liabilities.

37. The polypeptide of embodiment 26, wherein the polypeptide comprises a set of mutations of T85L, H121Y, N130K, M134L, E154D, N190D, N229E, A289P, N303S, and N336Q, and wherein the polypeptide has increased stability, reduced, or no binding to an anti-drug antibody, no T-cell binding epitope, and/or no chemical liabilities.

38. The polypeptide of embodiment 26, wherein the polypeptide comprises a set of mutations of T85L, H121Y, M134L, E154D, N190D, N229E, A289P, N303S, and N336Q, and wherein the polypeptide has increased stability, reduced, or no binding to an anti-drug antibody, no T-cell binding epitope, and/or no chemical liabilities.

39. The polypeptide of embodiment 26, wherein the polypeptide comprises a set of mutations of T85L, H121Y, N130K, M134L, E154D, N190D, N229E, V258G, A289P, and N303S, and wherein the polypeptide has increased stability, reduced, or no binding to an anti-drug antibody, no T-cell binding epitope, and/or no chemical liabilities.

40. The polypeptide of embodiment 26, wherein the polypeptide comprises a set of mutations of T85L, H121Y, M134L, E154D, N190D, N229E, V258G, A289P, N303S, and N336Q, and wherein the polypeptide has increased stability, reduced, or no binding to an anti-drug antibody, no T-cell binding epitope, and/or no chemical liabilities.

41. A polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336, as compared to SEQ ID NO: 35.

42. The polypeptide of embodiment 41, wherein the polypeptide comprises the set of mutations at positions selected from:
  60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
  60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;
  60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
  60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
  60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

43. The polypeptide of embodiment 42, wherein the polypeptide comprises:
  the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
  the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;
  the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations at positions 60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
  the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations at positions 60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; or
  the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

44. The polypeptide of embodiment 41, wherein the mutation, or the mutation set is selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35.

45. The polypeptide of embodiment 44, wherein the polypeptide comprises a set of mutations selected from:
  A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;
  A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;
  A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;
  A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

46. The polypeptide of embodiment 41, wherein the polypeptide comprises:
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations of A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations of A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; or
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

47. The polypeptide of embodiment 41, wherein the polypeptide comprises an amino acid sequence selected from any one of SEQ ID NOs: 1290, 1295, 1301, 1303, or 1310.

48. A polypeptide comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 55-1019, 1290-1310 and 1333.

49. The polypeptide of embodiment 48, wherein the polypeptide has protease activity.

50. The polypeptide of any one of embodiments 48-49, wherein the polypeptide having protease activity is a polypeptide having IgG cleaving protease activity.

51. The polypeptide of embodiment 50, wherein the polypeptide having IgG cleaving protease activity is selected from IdeS, IdeZ, IdeZ2, or Ide85 protease variant.

52. The polypeptide of embodiment 51, wherein the IdeS, IdeZ, IdeZ2, or Ide85 protease variant has the same or improved protease activity as compared to wild-type IdeS, IdeZ, IdeZ2, or Ide85 protease.

53. The polypeptide of any one of embodiments 48-52, wherein the polypeptide comprises the amino acid sequence of any one of SEQ ID NO: 55-1019, 1290-1310 and 1333.

54. The polypeptide of any one of embodiments 48-53, wherein the polypeptide has an increased or decreased recognition by an anti-protease antibody.

55. The polypeptide of any one of embodiments 48-54, wherein the polypeptide further does not comprise a methionine (M) amino acid residue at the N-terminus of said polypeptide.

56. The polypeptide of any one of embodiments 48-55, wherein the polypeptide comprises a methionine (M) amino acid residue at the N-terminus of said polypeptide.

57. The polypeptide of any one of embodiments 48-56, wherein the polypeptide does not comprise a His-tag at the C-terminus of said polypeptide.

58. The polypeptide of any one of embodiments 48-57, wherein the polypeptide comprises a His-tag at the C-terminus of said polypeptide.

59. A polypeptide comprising an amino acid of any one of SEQ ID NO: 1290-1310 and 1333.

60. The polypeptide of embodiment 59, wherein the polypeptide has protease activity.

61. The polypeptide of any one of embodiments 59-60, wherein the polypeptide having protease activity is a polypeptide having IgG cleaving protease activity.

62. The polypeptide of any one of embodiments 59-61, wherein the polypeptide has an increased or decreased recognition by an anti-protease antibody.

63. The polypeptide of any one of embodiments 59-62, wherein the polypeptide has increased, decreased, or equal activity to wild-type IdeS protease.

64. A polypeptide having an amino acid sequence of any one of SEQ ID NOs: 1290, 1295, 1301, 1303, or 1310.

65. The polypeptide of any one of embodiments 20-64, wherein the polypeptide is less immunogenic than a wild-type protease.

66. The polypeptide of any one of embodiments 20-64, wherein the polypeptide is as immunogenic than a wild-type protease.

67. The polypeptide of any one of embodiments 65-66, wherein the wild-type protease is selected from IdeS, IdeZ, IdeZ2, or Ide85 protease variant 68. A molecule comprising:
    a polypeptide comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 55-1019, 1290-1310 and 1333; and
    an Fc polypeptide,
    wherein the polypeptide is covalently or non-covalently connected (e.g. conjugated via a peptide bond or through electrostatic interactions) to the Fc polypeptide.

69. The molecule of embodiment 68, wherein the polypeptide is a polypeptide having protease activity.

70. The molecule of embodiment 69, wherein the polypeptide having protease activity is a polypeptide having IgG cleaving protease activity.

71. The molecule of embodiment 70, wherein the polypeptide having IgG cleaving protease activity is selected from IdeS, IdeZ, IdeZ2, or Ide85 protease variant.

72. The molecule of any one of embodiments 68-71, wherein the polypeptide comprises the amino acid sequence of any one of SEQ ID NO: 55-1019, 1290-1310 and 1333.

73. The molecule of any one of embodiments 68-72, wherein the polypeptide has an increased or decreased recognition by an anti-protease antibody.

74. The molecule of any one of embodiments 68-73, wherein the polypeptide has increased, decreased, or equal activity to wild-type IdeS, IdeZ, IdeZ2, or Ide85 protease.

75. The molecule of any one of embodiments 68-74, wherein the polypeptide further does not comprise a methionine (M) amino acid residue at the N-terminus of said polypeptide.

76. The molecule of any one of embodiments 68-75, wherein the polypeptide comprises a methionine (M) amino acid residue at the N-terminus of said polypeptide.

77. The molecule of embodiment 68, wherein the Fc polypeptide is resistant to cleavage by a protease, or a variant thereof, and/or binding by a protease, or a variant thereof.

78. The molecule of any one of embodiments 68-77, wherein the Fc polypeptide is a variant Fc polypeptide.

79. The molecule of embodiment 78, wherein the variant Fc polypeptide comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 1, provided that the variant Fc polypeptide comprises a mutation set selected from:
    L234A, L235A, G237A, Y296Q, and P329K;
    L234A, L235A, G237A, Y296Q, S298K, and P329K;
    L234A, L235A, G237A, D265K, E269S, Y296Q, and P329K; or
    L234A, L235A, G237A, D265K, E269S, Y296Q, S298K, and P329K.

80. The molecule of any one of embodiments 78-79, wherein the variant Fc polypeptide comprises mutations corresponding to L234A, L235A, G237A, Y296Q, and P329K according to SEQ ID NO: 1.

81. The molecule of any one of embodiments 78-79, wherein the variant Fc polypeptide comprises mutations corresponding to L234A, L235A, G237A, Y296Q, S298K, and P329K according to SEQ ID NO: 1.

82. The molecule of any one of embodiments 78-79, wherein the variant Fc polypeptide comprises mutations corresponding to L234A, L235A, G237A, D265K, E269S, Y296Q, and P329K according to SEQ ID NO: 1.

83. The molecule of any one of embodiments 78-79, wherein the variant Fc polypeptide comprises mutations corresponding to L234A, L235A, G237A, D265K, E269S, Y296Q, S298K, and P329K according to SEQ ID NO: 1.

84. The molecule of any one of embodiments 78-83, wherein the variant Fc polypeptide comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, 20, 21, 22, 23, 24, or 25, provided that the variant Fc polypeptide comprises a set of mutations selected from:
    L234A, L235A, G237A, Y296Q, and P329K;
    L234A, L235A, G237A, Y296Q, S298K, and P329K;
    L234A, L235A, G237A, D265K, E269S, Y296Q, and P329K; or
    L234A, L235A, G237A, D265K, E269S, Y296Q, S298K, and P329K;
    as compared to SEQ ID NO: 19, 20, 21, 22, 23, 24, or 25.

85. The molecule of embodiment 84, wherein the variant IgG Fc comprises:
    an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, and P329K mutations, as compared to SEQ ID NO: 19;
    an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, and P329K mutations, as compared to SEQ ID NO: 20;
    an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, and P329K mutations, as compared to SEQ ID NO: 21;
    an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, and P329K mutations, as compared to SEQ ID NO: 22;
    an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, S298K, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, S298K, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, S298K, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, S298K, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, S298K, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, S298K, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, S298K, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, S298K, and P329K mutations, as compared to SEQ ID NO: 19;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, S298K, and P329K mutations, as compared to SEQ ID NO: 20;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, S298K, and P329K mutations, as compared to SEQ ID NO: 21;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, S298K, and P329K mutations, as compared to SEQ ID NO: 22;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, S298K, and P329K mutations, as compared to SEQ ID NO: 23;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, S298K, and P329K mutations, as compared to SEQ ID NO: 24; or
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, S298K, and P329K mutations, as compared to SEQ ID NO: 25.

86. The molecule of any one of embodiments 78-85, wherein the variant Fc polypeptide comprises:
an amino acid sequence of SEQ ID NO: 19;
an amino acid sequence of SEQ ID NO: 21;
an amino acid sequence of SEQ ID NO: 22;
an amino acid sequence of SEQ ID NO: 23;
an amino acid sequence of SEQ ID NO: 24; or
an amino acid sequence of SEQ ID NO: 25.

87. The molecule of any one of embodiments 68-86, wherein the polypeptide having protease activity is covalently or non-covalently conjugated to the N-terminus of the Fc polypeptide.

88. The molecule of any one of embodiments 68-86, wherein the polypeptide having protease activity is covalently or non-covalently conjugated to the C-terminus of the Fc polypeptide.

89. The molecule of any one of embodiments 68-88, wherein the polypeptide having protease activity is conjugated to the C-terminus of the Fc polypeptide via a peptide linker.

90. The molecule of any one of embodiments 68-88, wherein the polypeptide having protease activity is conjugated to the N-terminus of the Fc polypeptide via a peptide linker.

91. The molecule of any one of embodiments 68-90, wherein the peptide linker is a glycine/serine linker.

92. The molecule of any one of embodiments 68-91, wherein the polypeptide optionally comprises a nanobody.

93. The molecule of embodiment 92, wherein the nanobody comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 30, 32, or 33.

94. The molecule of any one of embodiments 92-93, wherein the nanobody is covalently or non-covalently conjugated to the N-terminus or the C-terminus of the polypeptide having protease activity.

95. The molecule of embodiment 94, wherein the nanobody is covalently or non-covalently conjugated to the N-terminus of the Fc polypeptide, and wherein the C-terminus of the Fc polypeptide is covalently or non-covalently conjugated to the N-terminus of the polypeptide having protease activity.

96. The molecule of embodiment 94, wherein the nanobody is covalently or non-covalently conjugated to the C-terminus of the Fc polypeptide, and wherein the N-terminus of the Fc polypeptide is covalently or non-covalently conjugated to the C-terminus of the polypeptide having protease activity.

97. The molecule of any one of embodiments 68-96, wherein the polypeptide optionally comprises a His-tag.

98. The molecule of embodiment 97, wherein the His-tag is covalently or non-covalently conjugated to the C-terminus or the N-terminus of the polypeptide.

99. The molecule of any one of embodiments 97-98, wherein the His-tag has the amino acid sequence of SEQ ID NO: 27, or 34.

100. The molecule of any one of embodiments 68-99, wherein the polypeptide self-associates, or associates with another polypeptide, to form a dimer.

101. The molecule of embodiment 100, wherein the dimer is a homodimer or a heterodimer.

102. The molecule of any one of embodiments 100-101, wherein the dimer comprises a first polypeptide and a second polypeptide.

103. The molecule of embodiment 102, wherein:
the first polypeptide comprises the polypeptide of any one of embodiments 55-89; and
the second polypeptide comprises the polypeptide of any one of embodiments 55-89.

104. A molecule comprising:
a polypeptide comprising an amino acid sequence of any one of SEQ ID NO: 1290-1310 and 1333; and
an Fc polypeptide,
wherein the polypeptide is covalently or non-covalently connected (e.g. conjugated via a peptide bond or through electrostatic interactions) to the Fc polypeptide.

105. The molecule of embodiment 104, wherein the polypeptide comprises the amino acid sequence of any one of SEQ ID NO: 1290-1310 and 1333.

106. The molecule of any one of embodiments 104-105, wherein the polypeptide is a polypeptide having protease activity.

107. The molecule of embodiment 106, wherein the polypeptide having protease activity is a polypeptide having IgG cleaving protease activity.

108. The molecule of embodiment 107, wherein the polypeptide having IgG cleaving protease activity is selected from IdeS, IdeZ, IdeZ2, or Ide85 protease variant.

109. The molecule of any one of embodiments 104-108, wherein the polypeptide has increased, decreased, or equal activity to wild-type IdeS, IdeZ, IdeZ2, or Ide85 protease.

110. The molecule of any one of embodiments 104-109, wherein the polypeptide has an increased or decreased recognition by an anti-protease antibody.

111. The molecule of any one of embodiments 104-110, wherein the polypeptide further does not comprise a methionine (M) amino acid residue at the N-terminus of said polypeptide.

112. The molecule of any one of embodiments 104-110, wherein the polypeptide comprises a methionine (M) amino acid residue at the N-terminus of said polypeptide.

113. The molecule of embodiment 104, wherein the Fc polypeptide is resistant to cleavage by a protease, or a variant thereof, and/or binding by a protease, or a variant thereof.

114. The molecule of any one of embodiments 104-113, wherein the Fc polypeptide is a variant Fc polypeptide.

115. The molecule of embodiment 114, wherein the variant Fc polypeptide comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 1, provided that the variant Fc polypeptide comprises a mutation set selected from:
L234A, L235A, G237A, Y296Q, and P329K;
L234A, L235A, G237A, Y296Q, S298K, and P329K;
L234A, L235A, G237A, D265K, E269S, Y296Q, and P329K; or
L234A, L235A, G237A, D265K, E269S, Y296Q, S298K, and P329K.

116. The molecule of any one of embodiments 114-115, wherein the variant Fc polypeptide comprises mutations corresponding to L234A, L235A, G237A, Y296Q, and P329K according to SEQ ID NO: 1.

117. The molecule of any one of embodiments 114-115, wherein the variant Fc polypeptide comprises mutations corresponding to L234A, L235A, G237A, Y296Q, S298K, and P329K according to SEQ ID NO: 1.

118. The molecule of any one of embodiments 114-115, wherein the variant Fc polypeptide comprises mutations corresponding to L234A, L235A, G237A, D265K, E269S, Y296Q, and P329K according to SEQ ID NO: 1.

119. The molecule of any one of embodiments 114-115, wherein the variant Fc polypeptide comprises mutations corresponding to L234A, L235A, G237A, D265K, E269S, Y296Q, S298K, and P329K according to SEQ ID NO: 1.

120. The molecule of any one of embodiments 114-119, wherein the variant Fc polypeptide comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, 20, 21, 22, 23, 24, or 25, provided that the variant Fc polypeptide comprises a set of mutations selected from:
L234A, L235A, G237A, Y296Q, and P329K;
L234A, L235A, G237A, Y296Q, S298K, and P329K;
L234A, L235A, G237A, D265K, E269S, Y296Q, and P329K; or
L234A, L235A, G237A, D265K, E269S, Y296Q, S298K, and P329K;
as compared to SEQ ID NO: 19, 20, 21, 22, 23, 24, or 25.

121. The molecule of embodiment 120, wherein the variant IgG Fc comprises:
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, and P329K mutations, as compared to SEQ ID NO: 19;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, and P329K mutations, as compared to SEQ ID NO: 20;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, and P329K mutations, as compared to SEQ ID NO: 21;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, and P329K mutations, as compared to SEQ ID NO: 22;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, and P329K mutations, as compared to SEQ ID NO: 23;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, and P329K mutations, as compared to SEQ ID NO: 24;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, and P329K mutations, as compared to SEQ ID NO: 25;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, Y296Q, S298K, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, Y296Q, S298K, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, Y296Q, S298K, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, Y296Q, S298K, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, S298K, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, Y296Q, S298K, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, Y296Q, S298K, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, and P329K mutations, as compared to SEQ ID NO: 22;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, and P329K mutations, as compared to SEQ ID NO: 23;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, and P329K mutations, as compared to SEQ ID NO: 24;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, and P329K mutations, as compared to SEQ ID NO: 25;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 19, provided that the variant Fc polypeptide comprises a set of L234A, L235A, G237A, D265K, E269S, Y296Q, S298K, and P329K mutations, as compared to SEQ ID NO: 19;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 20, provided that the variant Fc polypeptide comprises a set of L234A, L235A, G237A, D265K, E269S, Y296Q, S298K, and P329K mutations, as compared to SEQ ID NO: 20;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 21, provided that the variant Fc polypeptide comprises a set of L234A, L235A, G237A, D265K, E269S, Y296Q, S298K, and P329K mutations, as compared to SEQ ID NO: 21;

an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 22, provided that the variant Fc polypeptide comprises a set of L234A, L235A, G237A, D265K, E269S, Y296Q, S298K, and P329K mutations, as compared to SEQ ID NO: 22;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, D265K, E269S, Y296Q, S298K, and P329K mutations, as compared to SEQ ID NO: 23;
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 24, provided that the variant Fc polypeptide comprises a set of L234A, L235A, G237A, D265K, E269S, Y296Q, S298K, and P329K mutations, as compared to SEQ ID NO: 24; or
an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 25, provided that the variant Fc polypeptide comprises a set of L234A, L235A, G237A, D265K, E269S, Y296Q, S298K, and P329K mutations, as compared to SEQ ID NO: 25.

122. The molecule of any one of embodiments 114-121, wherein the variant Fc polypeptide comprises:
an amino acid sequence of SEQ ID NO: 19;
an amino acid sequence of SEQ ID NO: 21;
an amino acid sequence of SEQ ID NO: 22;
an amino acid sequence of SEQ ID NO: 23;
an amino acid sequence of SEQ ID NO: 24; or
an amino acid sequence of SEQ ID NO: 25.

123. The molecule of any one of embodiments 104-122, wherein the polypeptide having protease activity is covalently or non-covalently conjugated to the N-terminus of the Fc polypeptide.

124. The molecule of any one of embodiments 104-122, wherein the polypeptide having protease activity is covalently or non-covalently conjugated to the C-terminus of the Fc polypeptide.

125. The molecule of any one of embodiments 104-124, wherein the polypeptide having protease activity is conjugated to the C-terminus of the Fc polypeptide via a peptide linker.

126. The molecule of any one of embodiments 104-124, wherein the polypeptide having protease activity is conjugated to the N-terminus of the Fc polypeptide via a peptide linker.

127. The molecule of any one of embodiments 104-126, wherein the peptide linker is a glycine/serine linker.

128. The molecule of any one of embodiments 104-127, wherein the polypeptide optionally comprises a nanobody.

129. The molecule of embodiment 128, wherein the nanobody comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 30, 32, or 33.

130. The molecule of any one of embodiments 128-129, wherein the nanobody is covalently or non-covalently conjugated to the N-terminus or the C-terminus of the polypeptide having protease activity.

131. The molecule of embodiment 130, wherein the nanobody is covalently or non-covalently conjugated to the N-terminus of the Fc polypeptide, and wherein the C-terminus of the Fc polypeptide is covalently or non-covalently conjugated to the N-terminus of the polypeptide having protease activity.

132. The molecule of embodiment 130, wherein the nanobody is covalently or non-covalently conjugated to the C-terminus of the Fc polypeptide, and wherein the N-terminus of the Fc polypeptide is covalently or non-covalently conjugated to the C-terminus of the polypeptide having protease activity.

133. The molecule of any one of embodiments 104-132, wherein the polypeptide optionally comprises a His-tag.

134. The molecule of embodiment 133, wherein the His-tag is covalently or non-covalently conjugated to the C-terminus or the N-terminus of the polypeptide.

135. The molecule of any one of embodiments 133-134, wherein the His-tag has the amino acid sequence of SEQ ID NO: 27, or 34.

136. The molecule of any one of embodiments 104-135, wherein the polypeptide self-associates, or associates with another polypeptide, to form a dimer.

137. The molecule of embodiment 136, wherein the dimer is a homodimer or a heterodimer.

138. The molecule of any one of embodiments 136-137, wherein the dimer comprises a first polypeptide and a second polypeptide.

139. The molecule of embodiment 138, wherein:
the first polypeptide comprises the polypeptide of any one of embodiments 104-138; and
the second polypeptide comprises the polypeptide of any one of embodiments 104-138.

140. A molecule comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 1023-1289, 1311-1329, and 1334-1336.

141. The molecule of embodiment 140, wherein the polypeptide comprises a polypeptide having protease activity.

142. The molecule of embodiment 141, wherein the polypeptide having protease activity is a polypeptide having IgG cleaving protease activity.

143. The molecule of embodiment 142, wherein the polypeptide having IgG cleaving protease activity is selected from IdeS, IdeZ, IdeZ2, or Ide85 protease variant.

144. The molecule of any one of embodiments 140-143, wherein the polypeptide has increased, decreased, or equal activity to wild-type IdeS, IdeZ, IdeZ2, or Ide85 protease.

145. The molecule of any one of embodiments 140-144, wherein the polypeptide having protease activity comprises an amino acid sequence selected from any one of SEQ ID NO: 753-1019, 1290-1310 and 1333.

146. The molecule of any one of embodiments 140-145, wherein the polypeptide has an increased or decreased recognition by an anti-protease antibody.

147. The molecule of embodiment 146, wherein the polypeptide comprises an Fc polypeptide.

148. The molecule of embodiment 147, wherein the Fc polypeptide is resistant to cleavage by a protease, or a variant thereof, and/or binding by a protease, or a variant thereof.

149. The molecule of any one of embodiments 147-148, wherein the Fc polypeptide is a variant Fc polypeptide.

150. The molecule of embodiment 149, wherein the variant Fc polypeptide comprises an amino acid sequence having at least 75%, at least 80%, at least 85%, at least 90%, at least 91%, at least 92%, at least 93%, at least 94%, at least 95%, at least 96%, at least 97%, at least 98%, or at least 99% identity to SEQ ID NO: 23, provided that the variant Fc polypeptide comprises a set of L234A, L235A, G237A, Y296Q, and P329K mutations, as compared to SEQ ID NO: 23;

151. The molecule of any one of embodiments 149-150, wherein the variant Fc polypeptide comprises an amino acid sequence of SEQ ID NO: 23.

152. The molecule of any one of embodiments 140-151, wherein the polypeptide comprises the amino acid sequence of any one of SEQ ID NO: 1023-1289, 1311-1329, and 1334-1336.

153. The molecule of any one of embodiments 140-152, wherein the polypeptide self-associates, or associates with another polypeptide, to form a dimer.

154. The molecule of embodiment 153, wherein the dimer is a homodimer or a heterodimer.

155. The molecule of any one of embodiments 153-154, wherein the dimer comprises a first polypeptide and a second polypeptide.

156. The molecule of embodiment 155, wherein:
the first polypeptide comprises the polypeptide of any one of embodiments 140-155; and
the second polypeptide comprises the polypeptide of any one of embodiments 140-155.

157. A molecule comprising:
an Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1, provided that the Fc polypeptide comprises a mutation, or a set of mutations at any one position, or any combination of positions selected from 234, 235, 237, 296, and 329 as compared to SEQ ID NO: 1; and
a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 35, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35,
wherein the polypeptide is linked or conjugated to N- or C-terminus of the Fc polypeptide.

158. The molecule of embodiment 157, wherein the Fc polypeptide comprises the set of mutations at positions 234, 235, 237, 296, and 329 as compared to SEQ ID NO: 1.

159. The molecule of embodiment 158, wherein the mutation, or the set of mutations is selected from any one, or any combination of L234A, L235A, G237A, Y296Q, and P329K as compared to SEQ ID NO: 1.

160. The molecule of embodiment 158, wherein the Fc polypeptide comprises the set of mutations of L234A, L235A, G237A, Y296Q, and P329K as compared to SEQ ID NO: 1.

161. The molecule of embodiment 157, wherein the polypeptide comprises the set of mutations at positions selected from:
60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, 336 as compared to SEQ ID NO: 35;
60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

162. The molecule of embodiment 157, wherein the polypeptide comprises the mutation, or the mutation set selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35.

163. The molecule of embodiment 162, wherein the polypeptide comprises a set of mutations selected from:
A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;
A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;
A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;
A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and
A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

164. A molecule comprising:
an Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1; and
a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336, as compared to SEQ ID NO: 35,
wherein the polypeptide is linked or conjugated to N- or C-terminus of the Fc polypeptide.

165. The molecule of embodiment 164, wherein the Fc polypeptide comprises the set of mutations at positions 234, 235, 237, 296, and 329 as compared to SEQ ID NO: 1.

166. The molecule of embodiment 165, wherein the mutation, or the set of mutations is selected from any one, or any combination of L234A, L235A, G237A, Y296Q, and P329K as compared to SEQ ID NO: 1.

167. The molecule of embodiment 166, wherein the Fc polypeptide comprises the set of mutations of L234A, L235A, G237A, Y296Q, and P329K as compared to SEQ ID NO: 1.

168. The molecule of embodiment 164, wherein the Fc polypeptide comprises the amino acid sequence of SEQ ID NO: 23.

169. The molecule of embodiment 164, wherein the polypeptide comprises the set of mutations at positions selected from:
60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;
60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

170. The molecule of embodiment 164, wherein the polypeptide comprises:
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations at positions 60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations at positions 60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; or
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

171. The molecule of embodiment 164, wherein the polypeptide comprises the mutation, or the mutation set selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35.

172. The molecule of embodiment 164, wherein the polypeptide comprises a set of mutations selected from:

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

173. The molecule of embodiment 164, wherein the polypeptide comprises:

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations of A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations of A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; or the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

174. The molecule of embodiment 164, wherein the polypeptide comprises an amino acid sequence selected from any one of SEQ ID NOs: 1290, 1295, 1301, 1303, or 1310.

175. A molecule comprising:
an Fc polypeptide having an amino acid sequence of SEQ ID NO: 23; and
a polypeptide having an amino acid sequence of any one of SEQ ID NOs: 1290, 1295, 1301, 1303, or 1310,
wherein the polypeptide is linked or conjugated to N- or C-terminus of the Fc polypeptide.

176. The molecule of embodiment 175, comprising from N- to C-terminus:
the Fc polypeptide having an amino acid sequence of SEQ ID NO: 23, and the polypeptide having an amino acid sequence of SEQ ID NO: 1290;
the Fc polypeptide having an amino acid sequence of SEQ ID NO: 23, and the polypeptide having an amino acid sequence of SEQ ID NO: 1295;
the Fc polypeptide having an amino acid sequence of SEQ ID NO: 23, and the polypeptide having an amino acid sequence of SEQ ID NO: 1301;

the Fc polypeptide having an amino acid sequence of SEQ ID NO: 23, and the polypeptide having an amino acid sequence of SEQ ID NO: 1303;

the Fc polypeptide having an amino acid sequence of SEQ ID NO: 23, and the polypeptide having an amino acid sequence of SEQ ID NO: 1310;

the polypeptide having an amino acid sequence of SEQ ID NO: 1290, and the Fc polypeptide having an amino acid sequence of SEQ ID NO: 23;

the polypeptide having an amino acid sequence of SEQ ID NO: 1295, and the Fc polypeptide having an amino acid sequence of SEQ ID NO: 23;

the polypeptide having an amino acid sequence of SEQ ID NO: 1301, and the Fc polypeptide having an amino acid sequence of SEQ ID NO: 23;

the polypeptide having an amino acid sequence of SEQ ID NO: 1303, and the Fc polypeptide having an amino acid sequence of SEQ ID NO: 23; or the polypeptide having an amino acid sequence of SEQ ID NO: 1310, and the Fc polypeptide having an amino acid sequence of SEQ ID NO: 23.

177. A molecule comprising:
i. a dimer Fc molecule comprising:
a first Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1(WT), provided that the Fc polypeptide comprises a mutation, or a set of mutations at any one position, or any combination of positions selected from 234, 235, 237, 296, and 329 as compared to SEQ ID NO: 1; and
a second Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1(WT), provided that the Fc polypeptide comprises a mutation, or a set of mutations at any one position, or any combination of positions selected from 234, 235, 237, 296, and 329 as compared to SEQ ID NO: 1,
wherein the first Fc polypeptide and the second Fc polypeptide associate with each other to form the dimer Fc molecule; and
ii. a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 35, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336 as compared to SEQ ID NO: 35,
wherein the polypeptide is linked or conjugated to N- or C-terminus of the first Fc polypeptide and/or the second Fc polypeptide.

178. The molecule of embodiment 177, wherein the Fc dimer molecule is a homodimer.

179. The molecule of embodiment 177, wherein the Fc dimer molecule is a heterodimer.

180. The molecule of embodiment 177, wherein the first Fc polypeptide comprises the set of mutations at positions 234, 235, 237, 296, and 329 as compared to SEQ ID NO: 1.

181. The molecule of embodiment 177, wherein the second Fc polypeptide comprises the set of mutations at positions 234, 235, 237, 296, and 329 as compared to SEQ ID NO: 1.

182. The molecule of embodiment 177, wherein:
the first Fc polypeptide comprises the set of mutations at positions 234, 235, 237, 296, and 329 as compared to SEQ ID NO: 1; and
the second Fc polypeptide comprises the set of mutations at positions 234, 235, 237, 296, and 329 as compared to SEQ ID NO: 1.

183. The molecule of embodiment 182, wherein the mutation, or the set of mutations is selected from any one, or any combination of L234A, L235A, G237A, Y296Q, and P329K as compared to SEQ ID NO: 1.

184. The molecule of embodiment 183, wherein:
the first Fc polypeptide comprises the set of mutations of L234A, L235A, G237A, Y296Q, and P329K as compared to SEQ ID NO: 1; and
the second Fc polypeptide comprises the set of mutations of L234A, L235A, G237A, Y296Q, and P329K as compared to SEQ ID NO: 1.

185. The molecule of embodiment 177, wherein the polypeptide comprises the set of mutations at positions selected from:
60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, 336 as compared to SEQ ID NO: 35;
60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

186. The molecule of embodiment 177, wherein the polypeptide comprises the mutation, or the mutation set selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35.

187. The molecule of embodiment 177, wherein the polypeptide comprises the set of mutations selected from:
A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

188. A molecule comprising:
i. a dimer Fc molecule comprising:
a first Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1; and
a second Fc polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 23, provided that the Fc polypeptide comprises a mutation, or a set of mutations at any one position, or any combination of positions selected from 234, 235, 237, 296, and 329 as compared to SEQ ID NO: 1,
wherein the first Fc polypeptide and the second Fc polypeptide associate with each other to form the dimer Fc molecule; and
ii. a polypeptide comprising an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, 1295, 1301, 1303, or 1310, provided that the polypeptide comprises a mutation, or a set of mutations at any one position, or any combination of positions selected from 60, 61, 63, 64, 69, 74, 76, 85, 112, 115, 116, 119, 120, 121, 130, 134, 145, 146, 154, 190, 198, 223, 225, 227, 231, 241, 251, 258, 261, 273, 274, 278, 286, 289, 303, 314, 334, and 336, as compared to SEQ ID NO: 35,
wherein the polypeptide is linked or conjugated to N- or C-terminus of the first Fc polypeptide and/or the second Fc polypeptide.

189. The molecule of embodiment 188, wherein the Fc dimer molecule is a homodimer.

190. The molecule of embodiment 188, wherein the Fc dimer molecule is a heterodimer.

191. The molecule of embodiment 188, wherein the first Fc polypeptide comprises the set of mutations at positions 234, 235, 237, 296, and 329 as compared to SEQ ID NO: 1.

192. The molecule of embodiment 188, wherein the second Fc polypeptide comprises the set of mutations at positions 234, 235, 237, 296, and 329 as compared to SEQ ID NO: 1.

193. The molecule of embodiment 188, wherein:
the first Fc polypeptide comprises the set of mutations at positions 234, 235, 237, 296, and 329 as compared to SEQ ID NO: 1; and
the second Fc polypeptide comprises the set of mutations at positions 234, 235, 237, 296, and 329 as compared to SEQ ID NO: 1.

194. The molecule of embodiment 193, wherein the mutation, or the set of mutations is selected from any one, or any combination of L234A, L235A, G237A, Y296Q, and P329K as compared to SEQ ID NO: 1.

195. The molecule of embodiment 194, wherein:
the first Fc polypeptide comprises the set of mutations of L234A, L235A, G237A, Y296Q, and P329K as compared to SEQ ID NO: 1; and
the second Fc polypeptide comprises the set of mutations of L234A, L235A, G237A, Y296Q, and P329K as compared to SEQ ID NO: 1.

196. The molecule of embodiment 188, wherein the first Fc polypeptide comprises the amino acid sequence of SEQ ID NO: 23, and the second Fc polypeptide comprises the amino acid sequence of SEQ ID NO: 23.

197. The molecule of embodiment 188, wherein the polypeptide comprises the set of mutations at positions selected from:
60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;
60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;
60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;
60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; and
60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

198. The molecule of embodiment 188, wherein the polypeptide comprises:
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 273, 274, 278, 289, 303, 314, 334, and 336 as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 258, 273, 274, 278, 289, 303, 314, 334, and 336 as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations at positions 60, 61, 63, 64, 69, 74, 76, 85, 112, 115, 116, 119, 120, 121, 134, 145, 146, 154, 190, 198, 223, 225, 227, 231, 241, 251, 273, 274, 278, 286, 289, 303, 314, 334, and 336 as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations at positions 60, 61, 63, 64, 69, 74, 76, 85, 112, 116, 119, 120, 121, 130, 134, 145, 146, 154, 190, 198, 223, 225, 227, 231, 241, 251, 261, 273, 274, 278, 289, 303, 314, and 334 as compared to SEQ ID NO: 35; or the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations at positions 60, 61, 63, 64, 69, 74, 76, 85, 112, 115, 116, 119, 120, 121, 130, 134, 145, 146, 154, 190, 198, 223, 225, 227, 231, 241, 251, 261, 273, 274, 278, 289, 303, 314, 334, and 336 as compared to SEQ ID NO: 35.

199. The molecule of embodiment 188, wherein the polypeptide comprises the mutation, or the mutation set selected from any one, or any combination of A60T, N61D, T63I, Q64Y, F69L, V74K, N76G, T85L, D112E, K115E, R116N, E119K, E120K, H121Y, N130K, N130G, M134L, N145D, H146S, E154D, N190D, E198R, S223N, H225Y, F227L, N231T, K241Q, L251I, V258G, N261G, S273A, N274E, K278E, D286N, A289P, A303S, K314E, S334I, and N336Q as compared to SEQ ID NO: 35.

200. The molecule of embodiment 188, wherein the polypeptide comprises a set of mutations:
A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; and A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

201. The molecule of embodiment 188, wherein the polypeptide comprises:
the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1290, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, S273A, N274E, K278E, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1295, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, V258G, S273A, N274E, K278E, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1301, provided that the polypeptide comprises the set of mutations of A60T, N61D, T63I, Q64Y, F69L, V74K, N76G, T85L, D112E, K115E, R116N, E119K, E120K, H121Y, M134L, N145D, H146S, E154D, N190D, E198R, S223N, H225Y, F227L, N231T, K241Q, L251I, S273A, N274E, K278E, D286N, A289P, A303S, K314E, S334I, and N336Q as compared to SEQ ID NO: 35;

the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises the set of mutations of A60T, N61D, T63I, Q64Y, F69L, V74K, N76G, T85L, D112E, R116N, E119K, E120K, H121Y, N130G, M134L, N145D, H146S, E154D, N190D, E198R, S223N, H225Y, F227L, N231T, K241Q, L251I, N261G, S273A, N274E, K278E, A289P, A303S, K314E, and S334I as compared to SEQ ID NO: 35; or the amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1310, provided that the polypeptide comprises the set of mutations of A60T, N61D, T63I, Q64Y, F69L, V74K, N76G, T85L, D112E, K115E, R116N, E119K, E120K, H121Y, N130K, M134L, N145D, H146S, E154D, N190D, E198R, S223N, H225Y, F227L, N231T, K241Q, L251I, N261G, S273A, N274E, K278E, A289P, A303S, K314E, S334I, and N336Q as compared to SEQ ID NO: 35.

202. The molecule of embodiment 188, wherein the polypeptide comprises the amino acid sequence selected from any one, or any combination of SEQ ID NOs: 1290, 1295, 1301, 1303, or 1310.

203. A molecule comprising:
a dimer Fc molecule comprising a first Fc polypeptide having an amino acid sequence of SEQ ID NO: 23, and a second Fc polypeptide having an amino acid sequence of SEQ ID NO: 23, wherein the first Fc polypeptide and the second Fc polypeptide associate with each other to form the dimer Fc molecule; and
a polypeptide having an amino acid sequence of any one, or any combination of SEQ ID NOs: 1290, 1295, 1301, 1303, and 1310,
wherein the polypeptide is linked or conjugated to N- or C-terminus of the first Fc polypeptide and/or the second Fc polypeptide.

204. The molecule of embodiment 203, wherein the Fc dimer molecule is a homodimer.

205. The molecule of embodiment 203, wherein the Fc dimer molecule is a heterodimer.

206. The molecule of embodiment 203, comprising:
the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1290, wherein the polypeptide is linked or conjugated to N- or C-terminus of the first Fc polypeptide and/or the second Fc polypeptide;

the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1295, wherein the polypeptide is linked or conjugated to N- or C-terminus of the first Fc polypeptide and/or the second Fc polypeptide;

the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1301, wherein the polypeptide is linked or conjugated to N- or C-terminus of the first Fc polypeptide and/or the second Fc polypeptide;

the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1303, wherein the polypeptide is linked or conjugated to N- or C-terminus of the first Fc polypeptide and/or the second Fc polypeptide;

the dimer Fc molecule comprising the first Fc polypeptide having an amino acid sequence of SEQ ID NO: 23, the second Fc polypeptide having an amino acid sequence of SEQ ID NO: 23, and the polypeptide having an amino acid sequence of SEQ ID NO: 1310, wherein the polypeptide is linked or conjugated to N- or C-terminus of the first Fc polypeptide and/or the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1295, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1295 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1301, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1301 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1303, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1303 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1290, and the polypeptide having an amino acid sequence of SEQ ID NO: 1310, wherein the polypeptide having an amino acid sequence of SEQ ID NO: 1290 is linked or conjugated to N- or C-terminus of the first Fc polypeptide, and the polypeptide having an amino acid sequence of SEQ ID NO: 1310 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1290, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1290 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1301, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1301 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1303, wherein the polypeptide having an amino acid sequence of SEQ ID NO: 1295 is linked or conjugated to N- or C-terminus of the first Fc polypeptide, and the polypeptide having an amino acid sequence of SEQ ID NO: 1303 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1295, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1310 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1290, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1290 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1295, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1295 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1303, wherein the polypeptide having an amino acid sequence of SEQ ID NO: 1301 is linked or conjugated to N- or C-terminus of the first Fc polypeptide, and the polypeptide having an amino acid sequence of SEQ ID NO: 1303 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1301, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1310 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1290, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1290 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1295, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1295 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1301, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1301 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1303, and the polypeptide having an amino acid sequence of SEQ ID NO: 1310, wherein the polypeptide having an amino acid sequence of SEQ ID NO: 1303 is linked or conjugated to N- or C-terminus of the first Fc polypeptide, and the polypeptide having an amino acid sequence of SEQ ID NO: 1310 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1290, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1290 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1295, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1295 is linked or conjugated to N- or C-terminus of the second Fc polypeptide;

the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1301, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1301 is linked or conjugated to N- or C-terminus of the second Fc polypeptide; or the dimer Fc molecule comprising the first Fc polypeptide having an amino acid sequence of SEQ ID NO: 23, the second Fc polypeptide having an amino acid sequence of SEQ ID NO: 23, the polypeptide having an amino acid sequence of SEQ ID NO: 1310, and the polypeptide having an amino acid sequence of SEQ ID NO: 1303, wherein the polypeptide having an amino acid sequence of SEQ ID NO: 1310 is linked or conjugated to N- or C-terminus of the first Fc polypeptide, and the polypeptide having an amino acid sequence of SEQ ID NO: 1303 is linked or conjugated to N- or C-terminus of the second Fc polypeptide.

207. A molecule comprising an amino acid sequence of any one of SEQ ID NO: 1023-1289, 1311-1329, and 1334-1336.

208. The molecule of embodiment 207, wherein the polypeptide comprises a polypeptide having protease activity.

209. The molecule of embodiment 208, wherein the polypeptide having protease activity is a polypeptide having IgG cleaving protease activity.

210. The molecule of embodiment 209, wherein the polypeptide having IgG cleaving protease activity is selected from IdeS, IdeZ, IdeZ2, or Ide85 protease variant.

211. The molecule of any one of embodiments 207-210, wherein the polypeptide has increased, decreased, or equal activity to wild-type IdeS, IdeZ, IdeZ2, or Ide85 protease.

212. The molecule of any one of embodiments 207-211, wherein the polypeptide has an increased or decreased recognition by an anti-protease antibody.

213. The molecule of any one of embodiments 207-212, wherein the polypeptide self-associates, or associates with another polypeptide, to form a dimer.

214. The molecule of embodiment 213, wherein the dimer is a homodimer or a heterodimer.

215. The molecule of any one of embodiments 213-214, wherein the dimer comprises a first polypeptide and a second polypeptide.

216. The molecule of embodiment 215, wherein:
the first polypeptide comprises the polypeptide of any one of embodiments 207-215; and
the second polypeptide comprises the polypeptide of any one of embodiments 207-215.

217. The molecule of any one of embodiments 68-216, wherein the polypeptide is less immunogenic than a wild-type protease.

218. The molecule of any one of embodiments 68-216, wherein the polypeptide is as immunogenic than a wild-type protease.

219. The molecule of any one of embodiments 217-218, wherein the wild-type protease is selected from IdeS, IdeZ, IdeZ2, or Ide85 protease variant 220. A pharmaceutical composition comprising the polypeptide of any one of embodiments 1-67, or the molecule of any one of embodiments 68-219.

221. A method of treating a disease or disorder in a subject, the method comprising administering the polypeptide of any of embodiments 1-67, the molecule of any one of embodiments 68-219, or the pharmaceutical composition of embodiment 220, to the subject to treat the disease or disorder.

222. The method of embodiment 221, wherein the disease or disorder is selected from Addison's disease, Anti-GBM glomerulonephritis, anti-neutrophil cytoplasmic antibody-associated vasculitides, ANCA associated vasculitis, granulomatous polyangiitis (Wegener granulomatosis), eosinophilic granulomatosis with polyangiitis (Churg-Strauss syndrome), microscopic polyangiitis, anti-NMDAR encephalitis, anti-phospholipid antibody syndrome (APS) and catastrophic APS, autoimmune bullous skin diseases, pemphigus, pemphigus foliaceus (PF), fogo selvage (FS), pemphigus vulgaris (PV), autoimmune hemolytic anemia (AIHA), autoimmune hepatitis (AIH), autoimmune neutropenia (AIN), bullous pemphigoid (BP), Celiac's disease, chronic urticaria, complete congenital heart block (CCHB), diabetes type 1A (T1DM), epidermolysis bullosa acquisita (EBA), essential mixed cryoglobulinemia, Goodpasture's syndrome, anti-glomerular basement membrane disease, Graves' disease, Goitre, hyperthyroidism, infiltrative exophthalmos, infiltrative dermopathy, Guillain-Barre syndrome (GBS), acute inflammatory demyelinating polyneuropathy (AIDP), acute motor axonal neuropathy (AMAN), hemophilia, acquired FVII deficiency, idiopathic thrombocytopenic purpura (ITP), Lambert-Eaton myasthenic syndrome (LEMS), mixed connective tissue disease (MCTD), multiple myeloma, myasthenia gravis, myasthenic crisis, myocarditis, dilated cardiomyopathy (DCM), congestive cardiomyopathy, neuromyelitis optica (NMO), primary biliary cirrhosis (PBC), primary progressive multiple sclerosis (PPMS), relapsing-rheumatic multiple sclerosis, acute exacerbation of multiple sclerosis, rheumatic heart disease (RHD), rheumatoid arthritis (RA), serum-sickness, immune complex hypersensitivity (type III), Sjögren's syndrome (SS), lupus nephritis, systemic lupus erythematosus (SLE), cutaneous lupus (CLE), transplant rejection, thrombotic thrombocytopenic purpura (TTP), idiopathic inflammatory myopathies, polymyositis, dermatomyositis, inclusion body myositis, uveitis, scleritis, ankylosing spondylitis, axial spondyloarthritis, reactive arthritis, psoriatic arthritis, IBD-associated arthritis, antiphospholipid syndrome, systemic sclerosis, giant cell arteritis, polymyalgia rheumatic, Takayasu's arteritis, anti-neutrophil cytoplasmic antibody associated vasculitis, Henoch-Schonlein purpura, polyarteritis nodosa, Cogan's syndrome, Buerger's disease, Susan's disease, immune complex vasculitis, primary angiitis of the central nervous system (CNS), Behcet's disease, relapsing polychondritis, juvenile idiopathic arthritis, juvenile dermatomyositis, autoimmune brain disease, sarcoidosis, neurosarcoidosis, IgG4-related diseases, autoimmune complications of immune checkpoint inhibitors (IRAEs), adult onset Still's disease, warm antibody hemolytic anemia (wAIHA), immune thrombocytopenia, immune thrombotic thrombocytopenia, thrombic thrombocytopenia, pernicious anemia, aplastic anemia, Evan's syndrome, autoimmune neutropenia, acquired von Willibrand syndrome, recurring fetal loss, Rh mismatch, ulcerative colitis, autoimmune hepatitis, autoimmune pancreatitis, eosinophilic esophagitis/gastritis, primary sclerosing cholangitis, primary biliary sclerosis, glomerulonephritis, glomerular basement membrane disease, scleritis/episcleritis, uveitis, conjunctivitis, keratitis, type I diabetes mellitus, Hashimoto's thyroiditis, polyglandular autoimmune endocrine syndromes, atopic dermatitis, dermatitis herpetiformis, pemphigus foliaceus, fogo selvagem, cutaneous lupus erythematosus, linear IgA disease, Lichen planus, transplantation, antibody-mediated rejection, alloantibody hypersensitization, xenoantibody mediated rejection, solid organ rejection, graft vs. host disease (GVHD), multiple sclerosis, neuromyelitis optica, amyotrophic lateral sclerosis, Parkinson's disease, autoimmune encephalitis, CNS vasculitis, chronic idiopathic demyletinating polyneuropathy, transverse myelitis, optic neuritis, anti-myelin oligodendrocyte glycoprotein (MOG) disease, chronic meningitis, rheumatic heart disease, infectious disease, vaccination, antibody dependent enhancement, antibody to therapeutic biologic agents (cytokines, monoclonal antibodies, enzymes, coagulation factors), allergic asthma, eosinophilic pneumonia, nonspecific interstitial pneumonia, rheumatoid arthritis-associated interstitial lung disease (RA-ILD), sarcoidosis, hypersensitive pneumonitis, allergic bronchopulmonary mycosis, chronic rhinosinusitis with nasal polyps, or any combination thereof.

223. A method of treating a transplant subject comprising administering a therapeutically effective amount of the polypeptide of any of embodiments 1-67, the molecule of any one of embodiments 68-219, or the pharmaceutical composition of embodiment 220, to the subject, thereby treating the transplant (recipient) subject.

224. A method of improving a gene-therapy in subject comprising administering a therapeutically effective amount of the polypeptide of any of embodiments 1-67, the molecule of any one of embodiments 68-219, or the pharmaceutical composition of embodiment 220, to the subject, thereby improving the gene-therapy in the subject.

225. A method of treating a subject having, or at risk, or elevated risk, for having, an IgG mediated disease or disorder, comprising administering a therapeutically effective amount of the polypeptide of any embodiments 1-67, the molecule of any one of embodiments 68-219, or the pharmaceutical composition of embodiment 220, thereby treating the subject.

226. A method of cleaving B cell receptor, the method comprising administering a therapeutically effective amount of the polypeptide of any of embodiments 1-67, the molecule of any one of embodiments 68-219, or the pharmaceutical composition of embodiment 220, to cleave the B cell receptor.

227. The method of embodiment 226, wherein the polypeptide is administered to a cell, a tissue, an animal, or a subject.

228. The method of embodiment 227, wherein the cell, the tissue, the animal, or the subject is any cell, tissue, animal, or subject.

229. A nucleic acid encoding the polypeptide of any of embodiments 1-67 or the molecule of any one of embodiments 68-219.

230. A vector comprising the nucleic acid of embodiment 229.

231. A cell comprising the nucleic acid of embodiment 229 or the vector of embodiment 230.

232. A method of making the polypeptide comprising culturing a cell of embodiment 231 to make the therapeutic compound.

233. A method of making a nucleic acid sequence encoding the polypeptide of any one of embodiments 1-67 or the molecule of any one of embodiments 68-219, comprising
  a) providing a vector comprising sequence encoding a polypeptide having protease activity and inserting into the vector sequence encoding a variant Fc molecule to form an amino acid sequence encoding the polypeptide; or
  b) providing a vector comprising sequence encoding a variant Fc molecule and inserting into the vector sequence encoding a polypeptide having protease activity to form an amino acid sequence encoding the polypeptide, thereby making an amino acid sequence encoding the polypeptide.

234. A polypeptide comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 1303, provided that the polypeptide comprises a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, as compared to SEQ ID NO: 35.

235. The polypeptide of embodiment 1, wherein the polypeptide comprises a cysteine (C) at position 94; and/or has, at the positions in said variant sequence which correspond to positions 84, 262, 284 and 286 of SEQ ID NO: 35, a lysine (K), a histidine (H), an aspartic acid (D) and/or an aspartic acid (D), respectively.

236. The polypeptide of embodiment 235, wherein the polypeptide further comprises:
  a positively charged amino acid at a position 130, optionally wherein said positively charged amino acid is arginine (R) or lysine (K); and/or
  a positively charged amino acid at a position 131, optionally wherein said positively charged amino acid is arginine (R) or lysine (K).

237. The polypeptide of embodiment 235, wherein the polypeptide has protease activity.

238. The polypeptide of embodiment 237, wherein the polypeptide has IgG cleaving protease activity.

239. The polypeptide of embodiment 235, wherein the polypeptide is less immunogenic than a wild-type IdeS.

240. The polypeptide of any one of the preceding embodiments, wherein the polypeptide comprises an amino acid sequence of SEQ ID NO: 1303.

241. The polypeptide of embodiment 240, wherein the polypeptide is covalently or non-covalently conjugated to an Fc polypeptide.

242. The polypeptide of any one of the preceding embodiments, wherein the Fc polypeptide comprises an amino acid sequence having at least 90%, at least 91%, at least 92%, at least 93%, at least 94%, at least 95%, at least 96%, at least 97%, at least 98%, or at least 99% sequence identity to SEQ ID NO: 23.

243. The polypeptide of embodiment 242, wherein the Fc polypeptide comprises an amino acid sequence of SEQ ID NO: 23.

244. The polypeptide of embodiment 241, wherein the polypeptide is covalently or non-covalently conjugated to the N-terminus, or the C-terminus of the Fc polypeptide via a linker.

245. The polypeptide of embodiment 244, wherein the peptide linker is a peptide linker.

246. The polypeptide of embodiment 241, wherein the polypeptide comprises an amino acid sequence of SEQ ID NO: 1318.

247. The polypeptide of embodiment 241, wherein the Fc polypeptide self-associates to form a dimer.

248. A polypeptide comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 1290, 1291, 1292, 1293, 1294, 1295, 1296, 1297, 1298, 1299, 1300, 1301, 1302, 1304, 1305, 1306, 1307, 1308, 1309, 1310, and 1333, provided that the polypeptide comprises any one of, or any combination of, a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, an asparagine (N) at position 286, a proline (P) at position 289, a serine (S) at position 303, a glutamic acid (E) at position 314, an isoleucine (I) at position 334, and glutamine (Q) at position 336, as compared to SEQ ID NO: 35.

249. The polypeptide of embodiment 248, wherein the polypeptide comprises any one set selected from:
  a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35;
  a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 258, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336, as compared to SEQ ID NO: 35;
  a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, an alanine (A) at position 273, a glutamic acid (E) at position 274, a glutamic acid (E) at position 278, an asparagine (N) at position 286, a proline (P) at position 289, a serine (S) at position 303, a glutamic acid (E) at position 314, an isoleucine (I) at position 334, and a glutamine (Q) at position 336, as compared to SEQ ID NO: 35;
a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, as compared to SEQ ID NO: 35; or
a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, a glutamic acid (E) at position 115, an asparagine (N) at position 116, a lysine (K) at position 119, a lysine (K) at position 120, a tyrosine (Y) at position 121, a lysine (K) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, an isoleucine (I) at position 334, and a glutamine (Q) at position 336 as compared to SEQ ID NO: 35.

250. The polypeptide of embodiment 248, wherein the polypeptide comprises a cysteine (C) at position 94; and/or has, at the positions in said variant sequence which correspond to positions 84, 262, 284 and 286 of SEQ ID NO: 35, a lysine (K), a histidine (H), an aspartic acid (D) and/or an aspartic acid (D), respectively.

251. The polypeptide of embodiment 250, wherein the polypeptide further comprises:
a positively charged amino acid at a position 130, optionally wherein said positively charged amino acid is arginine (R) or lysine (K); and/or
a positively charged amino acid at a position 131, optionally wherein said positively charged amino acid is arginine (R) or lysine (K).

252. The polypeptide of embodiment 248, wherein the polypeptide has protease activity.

253. The polypeptide of any one of the preceding embodiments, wherein the polypeptide has IgG cleaving protease activity.

254. The polypeptide of any one of the preceding embodiments, wherein the polypeptide is less immunogenic than a wild-type IdeS.

255. The polypeptide of any one of the preceding embodiments, wherein the polypeptide comprises an amino acid sequence of SEQ ID NO: 1290, 1291, 1292, 1293, 1294, 1295, 1296, 1297, 1298, 1299, 1300, 1301, 1302, 1304, 1305, 1306, 1307, 1308, 1309, 1310, and 1333.

256. The polypeptide of any one of the preceding embodiments, wherein the polypeptide is covalently or non-covalently conjugated to an Fc polypeptide.

257. The polypeptide of any one of the preceding embodiments, wherein the Fc polypeptide comprises an amino acid sequence having at least 90%, at least 91%, at least 92%, at least 93%, at least 94%, at least 95%, at least 96%, at least 97%, at least 98%, or at least 99% sequence identity to any one of SEQ ID NO: 19, 20, 21, 22, 23, 24, or 25.

258. The polypeptide of any one of the preceding embodiments, wherein the Fc polypeptide comprises an amino acid sequence of any one of SEQ ID NO: 19, 20, 21, 22, 23, 24, or 25.

259. The polypeptide of any one of the preceding embodiments, wherein the polypeptide is covalently or non-covalently conjugated to the N-terminus, or the C-terminus of the Fc polypeptide via a linker.

260. The polypeptide of any one of the preceding embodiments, wherein the peptide linker is a peptide linker.

261. The polypeptide of any one of the preceding embodiments, wherein the polypeptide comprises, from N-terminus to C-terminus:
the Fc polypeptide having an amino acid sequence of SEQ ID NO: 23, and the polypeptide having an amino acid sequence of SEQ ID NO: 1290;
the Fc polypeptide having an amino acid sequence of SEQ ID NO: 23, and the polypeptide having an amino acid sequence of SEQ ID NO: 1291;
the Fc polypeptide having an amino acid sequence of SEQ ID NO: 23, and the polypeptide having an amino acid sequence of SEQ ID NO: 1292;
the Fc polypeptide having an amino acid sequence of SEQ ID NO: 23, and the polypeptide having an amino acid sequence of SEQ ID NO: 1293;
the Fc polypeptide having an amino acid sequence of SEQ ID NO: 23, and the polypeptide having an amino acid sequence of SEQ ID NO: 1294;
the Fc polypeptide having an amino acid sequence of SEQ ID NO: 23, and the polypeptide having an amino acid sequence of SEQ ID NO: 1295;
the Fc polypeptide having an amino acid sequence of SEQ ID NO: 23, and the polypeptide having an amino acid sequence of SEQ ID NO: 1296;

the Fc polypeptide having an amino acid sequence of SEQ ID NO: 23, and the polypeptide having an amino acid sequence of SEQ ID NO: 1297;
the Fc polypeptide having an amino acid sequence of SEQ ID NO: 23, and the polypeptide having an amino acid sequence of SEQ ID NO: 1298;
the Fc polypeptide having an amino acid sequence of SEQ ID NO: 23, and the polypeptide having an amino acid sequence of SEQ ID NO: 1299;
the Fc polypeptide having an amino acid sequence of SEQ ID NO: 23, and the polypeptide having an amino acid sequence of SEQ ID NO: 1300;
the Fc polypeptide having an amino acid sequence of SEQ ID NO: 23, and the polypeptide having an amino acid sequence of SEQ ID NO: 1301;
the Fc polypeptide having an amino acid sequence of SEQ ID NO: 23, and the polypeptide having an amino acid sequence of SEQ ID NO: 1302;
the Fc polypeptide having an amino acid sequence of SEQ ID NO: 23, and the polypeptide having an amino acid sequence of SEQ ID NO: 1304;
the Fc polypeptide having an amino acid sequence of SEQ ID NO: 23, and the polypeptide having an amino acid sequence of SEQ ID NO: 1305;
the Fc polypeptide having an amino acid sequence of SEQ ID NO: 23, and the polypeptide having an amino acid sequence of SEQ ID NO: 1306;
the Fc polypeptide having an amino acid sequence of SEQ ID NO: 23, and the polypeptide having an amino acid sequence of SEQ ID NO: 1307;
the Fc polypeptide having an amino acid sequence of SEQ ID NO: 23, and the polypeptide having an amino acid sequence of SEQ ID NO: 1308;
the Fc polypeptide having an amino acid sequence of SEQ ID NO: 23, and the polypeptide having an amino acid sequence of SEQ ID NO: 1309;
the Fc polypeptide having an amino acid sequence of SEQ ID NO: 23, and the polypeptide having an amino acid sequence of SEQ ID NO: 1310;
the Fc polypeptide having an amino acid sequence of SEQ ID NO: 23, and the polypeptide having an amino acid sequence of SEQ ID NO: 1333;
the polypeptide having an amino acid sequence of SEQ ID NO: 1290, and the Fc polypeptide having an amino acid sequence of SEQ ID NO: 23;
the polypeptide having an amino acid sequence of SEQ ID NO: 1291, and the Fc polypeptide having an amino acid sequence of SEQ ID NO: 23;
the polypeptide having an amino acid sequence of SEQ ID NO: 1292, and the Fc polypeptide having an amino acid sequence of SEQ ID NO: 23;
the polypeptide having an amino acid sequence of SEQ ID NO: 1293, and the Fc polypeptide having an amino acid sequence of SEQ ID NO: 23;
the polypeptide having an amino acid sequence of SEQ ID NO: 1294, and the Fc polypeptide having an amino acid sequence of SEQ ID NO: 23;
the polypeptide having an amino acid sequence of SEQ ID NO: 1295, and the Fc polypeptide having an amino acid sequence of SEQ ID NO: 23;
the polypeptide having an amino acid sequence of SEQ ID NO: 1296, and the Fc polypeptide having an amino acid sequence of SEQ ID NO: 23;
the polypeptide having an amino acid sequence of SEQ ID NO: 1297, and the Fc polypeptide having an amino acid sequence of SEQ ID NO: 23;
the polypeptide having an amino acid sequence of SEQ ID NO: 1298, and the Fc polypeptide having an amino acid sequence of SEQ ID NO: 23;
the polypeptide having an amino acid sequence of SEQ ID NO: 1299, and the Fc polypeptide having an amino acid sequence of SEQ ID NO: 23;
the polypeptide having an amino acid sequence of SEQ ID NO: 1300, and the Fc polypeptide having an amino acid sequence of SEQ ID NO: 23;
the polypeptide having an amino acid sequence of SEQ ID NO: 1301, and the Fc polypeptide having an amino acid sequence of SEQ ID NO: 23;
the polypeptide having an amino acid sequence of SEQ ID NO: 1302, and the Fc polypeptide having an amino acid sequence of SEQ ID NO: 23;
the polypeptide having an amino acid sequence of SEQ ID NO: 1304, and the Fc polypeptide having an amino acid sequence of SEQ ID NO: 23;
the polypeptide having an amino acid sequence of SEQ ID NO: 1305, and the Fc polypeptide having an amino acid sequence of SEQ ID NO: 23;
the polypeptide having an amino acid sequence of SEQ ID NO: 1306, and the Fc polypeptide having an amino acid sequence of SEQ ID NO: 23;
the polypeptide having an amino acid sequence of SEQ ID NO: 1307, and the Fc polypeptide having an amino acid sequence of SEQ ID NO: 23;
the polypeptide having an amino acid sequence of SEQ ID NO: 1308, and the Fc polypeptide having an amino acid sequence of SEQ ID NO: 23;
the polypeptide having an amino acid sequence of SEQ ID NO: 1309, and the Fc polypeptide having an amino acid sequence of SEQ ID NO: 23;
the polypeptide having an amino acid sequence of SEQ ID NO: 1310, and the Fc polypeptide having an amino acid sequence of SEQ ID NO: 23; or
the polypeptide having an amino acid sequence of SEQ ID NO: 1333, and the Fc polypeptide having an amino acid sequence of SEQ ID NO: 23.

262. The polypeptide of any one of the preceding embodiments, wherein the Fc polypeptide self-associates to form a dimer.

263. The polypeptide of any one of the preceding embodiments, wherein the dimer is a homodimer or a heterodimer.

264. The polypeptide of any one of the preceding embodiments, wherein the polypeptide comprises an amino acid sequence of SEQ ID NO: 1311, 1312, 1313, 1314, 1315, 1316, 1317, 1319, 1320, 1321, 1322, 1323, 1324, 1325, 1326, 1327, 1328, 1329, 1334, 1335, and 1336.

265. A polypeptide comprising an amino acid sequence having at least 50%, at least 60%, at least 70%, at least 80%, at least 85%, at least 90%, at least 91%, at least 92%, at least 93%, at least 94%, at least 95%, at least 96%, at least 97%, at least 98%, or at least 99% sequence identity to any one of SEQ ID NO: 55-1019.

266. The polypeptide of embodiment 265, wherein the polypeptide is a polypeptide having protease activity.

267. The polypeptide of embodiment 266, wherein the polypeptide has IgG cleaving protease activity.

268. The polypeptide of any one of the preceding embodiments, wherein the polypeptide comprises the amino acid sequence of any one of SEQ ID NO: 55-1019.

269. The polypeptide of any one of the preceding embodiments, wherein the polypeptide is covalently or non-covalently conjugated to an Fc polypeptide.

270. The polypeptide of any one of the preceding embodiments, wherein the Fc polypeptide comprises an amino acid sequence having at least 90%, at least 91%, at least 92%, at least 93%, at least 94%, at least 95%, at least 96%, at least 97%, at least 98%, or at least 99% sequence identity to any one of SEQ ID NO: 19, 20, 21, 22, 23, 24, or 25.

271. The polypeptide of any one of the preceding embodiments, wherein the Fc polypeptide comprises an amino acid sequence of any one of SEQ ID NO: 19, 20, 21, 22, 23, 24, or 25.

272. The polypeptide of any one of the preceding embodiments, wherein the polypeptide is covalently or non-covalently conjugated to the N-terminus, or the C-terminus of the Fc polypeptide via a linker.

273. The polypeptide of any one of the preceding embodiments, wherein the peptide linker is a peptide linker.

274. The polypeptide of any one of the preceding embodiments, wherein the Fc polypeptide self-associates, or associates with another Fc polypeptide, to form a dimer.

275. The polypeptide of any one of the preceding embodiments, wherein the dimer is a homodimer or a heterodimer.

276. The polypeptide of any one of the preceding embodiments, wherein the polypeptide comprises an amino acid sequence of SEQ ID NO: 1023-1289.

277. A pharmaceutical composition comprising the polypeptide of any one of the preceding embodiments.

278. A method of treating a disease or disorder in a subject, the method comprising administering the polypeptide of any one of the preceding embodiments, or the pharmaceutical composition of embodiment 277, to the subject to treat the disease or disorder.

279. The method of embodiment 278, wherein the disease or disorder is selected from Addison's disease, Anti-GBM glomerulonephritis, anti-neutrophil cytoplasmic antibody-associated vasculitides, ANCA associated vasculitis, granulomatous polyangiitis (Wegener granulomatosis), eosinophilic granulomatosis with polyangiitis (Churg-Strauss syndrome), microscopic polyangiitis, anti-NMDAR encephalitis, anti-phospholipid antibody syndrome (APS) and catastrophic APS, autoimmune bullous skin diseases, pemphigus, pemphigus foliaceus (PF), fogo selvage (FS), pemphigus vulgaris (PV), autoimmune hemolytic anemia (AIHA), autoimmune hepatitis (AIH), autoimmune neutropenia (AIN), bullous pemphigoid (BP), Celiac's disease, chronic urticaria, complete congenital heart block (CCHB), diabetes type 1A (T1DM), epidermolysis bullosa acquisita (EBA), essential mixed cryoglobulinemia, Goodpasture's syndrome, anti-glomerular basement membrane disease, Graves' disease, Goitre, hyperthyroidism, infiltrative exophthalmos, infiltrative dermopathy, Guillain-Barre syndrome (GBS), acute inflammatory demyelinating polyneuropathy (AIDP), acute motor axonal neuropathy (AMAN), hemophilia, acquired FVII deficiency, idiopathic thrombocytopenic purpura (ITP), Lambert-Eaton myasthenic syndrome (LEMS), mixed connective tissue disease (MCTD), multiple myeloma, myasthenia gravis, myasthenic crisis, myocarditis, dilated cardiomyopathy (DCM), congestive cardiomyopathy, neuromyelitis optica (NMO), primary biliary cirrhosis (PBC), primary progressive multiple sclerosis (PPMS), relapsing-rheumatic multiple sclerosis, acute exacerbation of multiple sclerosis, rheumatic heart disease (RHD), rheumatoid arthritis (RA), serum-sickness, immune complex hypersensitivity (type III), Sjögren's syndrome (SS), lupus nephritis, systemic lupus erythematosus (SLE), cutaneous lupus (CLE), transplant rejection, thrombotic thrombocytopenic purpura (TTP), idiopathic inflammatory myopathies, polymyositis, dermatomyositis, inclusion body myositis, uveitis, scleritis, ankylosing spondylitis, axial spondyloarthritis, reactive arthritis, psoriatic arthritis, IBD-associated arthritis, antiphospholipid syndrome, systemic sclerosis, giant cell arteritis, polymyalgia rheumatic, Takayasu's arteritis, anti-neutrophil cytoplasmic antibody associated vasculitis, Henoch-Schonlein purpura, polyarteritis nodosa, Cogan's syndrome, Buerger's disease, Susan's disease, immune complex vasculitis, primary angiitis of the central nervous system (CNS), Behcet's disease, relapsing polychondritis, juvenile idiopathic arthritis, juvenile dermatomyositis, autoimmune brain disease, sarcoidosis, neurosarcoidosis, IgG4-related diseases, autoimmune complications of immune checkpoint inhibitors (IRAEs), adult onset Still's disease, warm antibody hemolytic anemia (wAIHA), immune thrombocytopenia, immune thrombotic thrombocytopenia, thrombic thrombocytopenia, pernicious anemia, aplastic anemia, Evan's syndrome, autoimmune neutropenia, acquired von Willibrand syndrome, recurring fetal loss, Rh mismatch, ulcerative colitis, autoimmune hepatitis, autoimmune pancreatitis, eosinophilic esophagitis/gastritis, primary sclerosing cholangitis, primary biliary sclerosis, glomerulonephritis, glomerular basement membrane disease, scleritis/episcleritis, uveitis, conjunctivitis, keratitis, type I diabetes mellitus, Hashimoto's thyroiditis, polyglandular autoimmune endocrine syndromes, atopic dermatitis, dermatitis herpetiformis, pemphigus foliaceus, fogo selvagem, cutaneous lupus erythematosus, linear IgA disease, Lichen planus, transplantation, antibody-mediated rejection, alloantibody hypersensitization, xenoantibody mediated rejection, solid organ rejection, graft vs. host disease (GVHD), multiple sclerosis, neuromyelitis optica, amyotrophic lateral sclerosis, Parkinson's disease, autoimmune encephalitis, CNS vasculitis, chronic idiopathic demyletinating polyneuropathy, transverse myelitis, optic neuritis, anti-myelin oligodendrocyte glycoprotein (MOG) disease, chronic meningitis, rheumatic heart disease, infectious disease, vaccination, antibody dependent enhancement, antibody to therapeutic biologic agents (cytokines, monoclonal antibodies, enzymes, coagulation factors), allergic asthma, eosinophilic pneumonia, nonspecific interstitial pneumonia, rheumatoid arthritis-associated interstitial lung disease (RA-ILD), sarcoidosis, hypersensitive pneumonitis, allergic bronchopulmonary mycosis, chronic rhinosinusitis with nasal polyps, or any combination thereof.

280. A method of treating a transplant subject comprising administering a therapeutically effective amount of the polypeptide of any one of the preceding embodiments, or the pharmaceutical composition of embodiment 277, to the subject, thereby treating the transplant (recipient) subject.

281. A method of improving a gene-therapy in subject comprising administering a therapeutically effective amount of the polypeptide of any one of the preceding embodiments, or the pharmaceutical composition of embodiment 277, to the subject, thereby improving the gene-therapy in the subject.

282. A method of treating a subject having, or at risk, or elevated risk, for having, an IgG mediated disease or disorder, comprising administering a therapeutically effective amount of the polypeptide of any one of the preceding embodiments, or the pharmaceutical composition of embodiment 277, thereby treating the subject.

283. A method of cleaving B cell receptor, the method comprising administering a therapeutically effective amount of the polypeptide of any one of the preceding embodiments, or the pharmaceutical composition of embodiment 277, to cleave the B cell receptor.

284. A polypeptide comprising an amino acid sequence that is at least 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% identical to a polypeptide comprising the amino acid sequence of SEQ ID NO: 36 or 1349, provided that the polypeptide comprises one or more of, or all of the following: a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, wherein the positions correspond to the positions as in SEQ ID NO: 35.

285. The polypeptide of embodiment 284, wherein the polypeptide does not comprises the amino acid sequence of DSFSANQEIRYSEVTPYHVT (SEQ ID NO: 1351).

286. The polypeptide of embodiment 284, wherein the polypeptide does not comprises the amino acid sequence of DSFSANQEIRYSEVTPYH (SEQ ID NO: 1352).

287. The polypeptide of embodiment 284, wherein the polypeptide does not comprises the amino acid sequence of ANQEIRYSEVTPYHVT (SEQ ID NO: 1353).

288. The polypeptide of embodiment 284, wherein the polypeptide does not comprises the amino acid sequence of ANQEIRYSEVTPYH (SEQ ID NO: 1354).

289. The polypeptide of any one of embodiments 284-288, wherein the polypeptide does not comprise the amino acid sequence of NQTN (SEQ ID NO: 1355).

290. The polypeptide of any one of embodiments 284-289, wherein the polypeptide comprises the sequence of QQTN (SEQ ID NO: 1356) at the C-terminus of the polypeptide instead of the sequence of NQTN (SEQ ID NO: 1355).

291. The polypeptide of any one of embodiments, 284-290, wherein the polypeptide has a cysteine (C) at the position in said polypeptide which corresponds to position 94 of SEQ ID NO: 35.

292. The polypeptide of any one of embodiments, 284-291, wherein the polypeptide In some embodiments, the polypeptide has, at the positions in said variant sequence which correspond to positions 84, 262, 284 and 286 of SEQ ID NO: 35, a lysine (K), a histidine (H), an aspartic acid (D) and an aspartic acid (D), respectively.

293. The polypeptide of any one of embodiments, 284-292, wherein the polypeptide has a positively charged amino acid at the position in said variant which corresponds to position 130 of SEQ ID NO: 35, such as, arginine (R) or lysine (K).

294. The polypeptide of any one of embodiments, 284-293, wherein the polypeptide has a positively charged amino acid at the position in said variant which corresponds to position 131 of SEQ ID NO: 35, such as arginine (R) or lysine (K).

295. The polypeptide of any one of embodiments, 284-294, wherein the polypeptide has at least 80%, 81%, 82%, 83%, 84%, 85%, 86%, 87%, 88%, 89%, or 90% identity to the polypeptide of SEQ ID NO: 35 or SEQ ID NO: 1349.

296. The polypeptide of any one of embodiments of 284-294, wherein the polypeptide comprises a threonine (T) at position 60, an aspartic acid (D) at position 61, an isoleucine (I) at position 63, a tyrosine (Y) at position 64, a leucine (L) at position 69, a lysine (K) at position 74, a glycine (G) at position 76, a leucine (L) at position 85, a glutamic acid (E) at position 112, an asparagine (N) at position 116, a lysine (K) at position 119, a lysine (K) at position 120, a tyrosine (Y) at position 121, a glycine (G) at position 130, a leucine (L) at position 134, an aspartic acid (D) at position 145, a serine (S) at position 146, an aspartic acid (D) at position 154, an aspartic acid (D) at position 190, an arginine (R) at position 198, an asparagine (N) at position 223, a tyrosine (Y) at position 225, a leucine (L) at position 227, a threonine (T) at position 231, a glutamine (Q) at position 241, an isoleucine (I) at position 251, a glycine (G) at position 261, an alanine (A) at position 273, a glutamic acid (E) at position 274, a glutamic acid (E) at position 278, a proline (P) at position 289, a serine (S) at position 303, a glutamic acid (E) at position 314, and an isoleucine (I) at position 334, wherein the positions correspond to the positions as in SEQ ID NO: 35.

297. The polypeptide of any one of embodiments of 284-296, wherein polypeptide is linked to a protease resistant Fc domain.

298. The polypeptide of embodiment 297, wherein the protease resistant Fc domain is linked to the N-terminus or the C-terminus of the polypeptide of any one of embodiments 284-296.

299. The polypeptide of embodiment 298, wherein the protease resistant Fc domain is linked to the N-terminus of the polypeptide of any one of embodiments 284-296.

300. The polypeptide of any one of embodiments 297-299, wherein the protease resistant Fc domain is linked to the polypeptide of any one of embodiments 284-296 through a peptide linker, such as, but not limited to, those provided for herein.

301. The polypeptide of embodiment 300, wherein the peptide linker comprises the amino acid sequence of SEQ ID NO: 1330.

302. The polypeptide of any one of embodiments 297-301, wherein the protease resistant Fc domain is as provided for herein.

303. The polypeptide of any one of embodiments 297-302, wherein the protease resistant Fc domain comprises the amino acid sequence of any one of SEQ ID NOs: 19, 20, 21, 22, 23, 24, 25, 42, 43, 44, 45, 46, 47, 48, or 49.

304. The polypeptide of any one of embodiments 297-303, wherein the protease resistant Fc domain comprises the amino acid sequence of SEQ ID NO: 23.

305. The polypeptide of any one of embodiments 297-304, wherein the polypeptide comprises a polypeptide from N-terminus to C-terminus a protease resistant Fc domain, a peptide linker, and a polypeptide of any one of embodiments 284-296, wherein the C-terminus of the protease resistant Fc domain is linked to the N-terminus of the peptide linker and the C-terminus of the peptide linker is linked to the N-terminus of the polypeptide of any one of embodiments 284-296.

306. The polypeptide of embodiment 305, wherein the polypeptide comprises the amino acid sequence as set forth in Table 7 in the column labeled "Full length sequence" of VRT-1 through VRT-319.

307. The polypeptide of any one of embodiments of 284-306, wherein the polypeptide has Ig protease activity, such as IgG protease activity.

308. The polypeptide of any one of embodiments 284-307, wherein the polypeptide is less immunogenic than an IdeS polypeptide, wherein the IdeS polypeptide optionally comprises the amino acid sequence of SEQ ID NO: 35, SEQ ID NO: 36 or SEQ ID NO: 1349.

309. The polypeptide of any one of embodiments 284-308, wherein the polypeptide produces greater quantity of IgG cleavage fragments than IdeS (e.g., SEQ ID NO: 35, SEQ ID NO: 36, or SEQ ID NO: 1349).

310. A pharmaceutical composition comprising the polypeptide of any one of embodiments 284-309.

311. The pharmaceutical composition of embodiment 310, wherein the composition comprises a dimer comprising a first polypeptide comprising the polypeptide of any one of embodiments 284-309 and a second polypeptide comprising the polypeptide of any one of embodiments 284-309, wherein the first polypeptide and the second polypeptide are the same.

312. The pharmaceutical composition of embodiment 310, wherein the composition comprises a dimer comprising a first polypeptide comprising the polypeptide of any one of embodiments 284-296 linked to a first protease resistant Fc domain, and a second polypeptide comprising the polypeptide of any one of embodiments 284-296 linked to a second protease resistant Fc domain, wherein the first polypeptide and the second polypeptide are the same.

313. The pharmaceutical composition of embodiment 312, wherein the first protease resistant Fc domain and the second protease resistant Fc domain comprise the same amino acid sequence.

314. The pharmaceutical composition of embodiment 312, wherein the first protease resistant Fc domain and the second protease resistant Fc domain comprise different amino acid sequences, provided that the first and second Fc domains can form a dimer.

315. The pharmaceutical composition of any one of embodiments 312-314, wherein first and second protease resistant Fc domains comprise, independently, the amino acid sequence of any one of SEQ ID NOs: 19, 20, 21, 22, 23, 24, 25, 42, 43, 44, 45, 46, 47, 48, or 49.

316. The pharmaceutical composition of embodiment 313, wherein the protease resistant Fc domain comprises the amino acid sequence of SEQ ID NO: 23.

317. The polypeptide or pharmaceutical composition of any one of embodiments 297-316, wherein the protease resistant Fc domain is resistant to cleavage by an IdeS protease, or variant thereof, such as a polypeptide of any one of embodiments of 284-296.

318. A method of reducing immunoglobulins, such as IgG, in a subject, the method comprising administering to the subject a polypeptide or composition of any one of embodiments 284-317.

319. A method of treating a disease or disorder in a subject, the method comprising administering to the subject a polypeptide or composition of any one of embodiments 284-317 to treat the disease or disorder.

320. The method of embodiment 319, wherein the disease or disorder is selected from Addison's disease, Anti-GBM glomerulonephritis, anti-neutrophil cytoplasmic antibody-associated vasculitides, ANCA associated vasculitis, granulomatous polyangiitis (Wegener granulomatosis), eosinophilic granulomatosis with polyangiitis (Churg-Strauss syndrome), microscopic polyangiitis, anti-NMDAR encephalitis, anti-phospholipid antibody syndrome (APS) and catastrophic APS, autoimmune bullous skin diseases, pemphigus, pemphigus foliaceus (PF), fogo selvage (FS), pemphigus vulgaris (PV), autoimmune hemolytic anemia (AIHA), autoimmune hepatitis (AIH), autoimmune neutropenia (AIN), bullous pemphigoid (BP), Celiac's disease, chronic urticaria, complete congenital heart block (CCHB), diabetes type 1A (T1DM), epidermolysis bullosa acquisita (EBA), essential mixed cryoglobulinemia, Goodpasture's syndrome, anti-glomerular basement membrane disease, Graves' disease, Goitre, hyperthyroidism, infiltrative exophthalmos, infiltrative dermopathy, Guillain-Barre syndrome (GBS), acute inflammatory demyelinating polyneuropathy (AIDP), acute motor axonal neuropathy (AMAN), hemophilia, acquired FVII deficiency, idiopathic thrombocytopenic purpura (ITP), Lambert-Eaton myasthenic syndrome (LEMS), mixed connective tissue disease (MCTD), multiple myeloma, myasthenia gravis, myasthenic crisis, myocarditis, dilated cardiomyopathy (DCM), congestive cardiomyopathy, neuromyelitis optica (NMO), primary biliary cirrhosis (PBC), primary progressive multiple sclerosis (PPMS), relapsing-rheumatic multiple sclerosis, acute exacerbation of multiple sclerosis, rheumatic heart disease (RHD), rheumatoid arthritis (RA), serum-sickness, immune complex hypersensitivity (type III), Sjögren's syndrome (SS), lupus nephritis, systemic lupus erythematosus (SLE), cutaneous lupus (CLE), transplant rejection, thrombotic thrombocytopenic purpura (TTP), idiopathic inflammatory myopathies, polymyositis, dermatomyositis, inclusion body myositis, uveitis, scleritis, ankylosing spondylitis, axial spondyloarthritis, reactive arthritis, psoriatic arthritis, IBD-associated arthritis, antiphospholipid syndrome, systemic sclerosis, giant cell arteritis, polymyalgia rheumatic, Takayasu's arteritis, anti-neutrophil cytoplasmic antibody associated vasculitis, Henoch-Schonlein purpura, polyarteritis nodosa, Cogan's syndrome, Buerger's disease, Susan's disease, immune complex vasculitis, primary angiitis of the central nervous system (CNS), Behcet's disease, relapsing polychondritis, juvenile idiopathic arthritis, juvenile dermatomyositis, autoimmune brain disease, sarcoidosis, neurosarcoidosis, IgG4-related diseases, autoimmune complications of immune checkpoint inhibitors (IRAEs), adult onset Still's disease, warm antibody hemolytic anemia (wAIHA), immune thrombocytopenia, immune thrombotic thrombocytopenia, thrombic thrombocytopenia, pernicious anemia, aplastic anemia, Evan's syndrome, autoimmune neutropenia, acquired von Willibrand syndrome, recurring fetal loss, Rh mismatch, ulcerative colitis, autoimmune hepatitis, autoimmune pancreatitis, eosinophilic esophagitis/gastritis, primary sclerosing cholangitis, primary biliary sclerosis, glomerulonephritis, glomerular basement membrane disease, scleritis/episcleritis, uveitis, conjunctivitis, keratitis, type I diabetes mellitus, Hashimoto's thyroiditis, polyglandular autoimmune endocrine syndromes, atopic dermatitis, dermatitis herpetiformis, pemphigus foliaceus, fogo selvagem, cutaneous lupus erythematosus, linear IgA disease, Lichen planus, transplantation, antibody-mediated rejection, alloantibody hypersensitization, xenoantibody mediated rejection, solid organ rejection, graft vs. host disease (GVHD), multiple sclerosis, neuromyelitis optica, amyotrophic lateral sclerosis, Parkinson's disease, autoimmune encephalitis, CNS vasculitis, chronic idiopathic demyletinating polyneuropathy, transverse myelitis, optic neuritis, anti-myelin oligodendrocyte glycoprotein (MOG) disease, chronic meningitis, rheumatic heart disease, infectious disease, vaccination, antibody dependent enhancement, antibody to therapeutic biologic agents (cytokines, monoclonal antibodies, enzymes, coagulation factors), allergic asthma, eosinophilic pneumonia, nonspecific interstitial pneumonia, rheumatoid arthritis-associated interstitial lung disease (RA-ILD), sarcoidosis, hypersensitive pneumonitis, allergic bronchopulmonary mycosis, chronic rhinosinusitis with nasal polyps, or any combination thereof.

321. A method of treating a transplant subject comprising administering to the subject a therapeutically effective amount of a polypeptide or composition of any one of embodiments 284-317, thereby treating the transplant (recipient) subject.

322. A method of improving a gene-therapy in subject comprising administering to the subject a therapeutically effective amount a polypeptide or composition of any one of embodiments 284-317, prior to, after, or simultaneously with the gene therapy, thereby improving the gene-therapy in the subject.

323. A method of treating a subject having, or at risk, or elevated risk, for having, an IgG mediated disease or disorder, comprising administering to the subject a therapeutically effective amount of a polypeptide or composition of any one of embodiments 284-317.

324. A method of cleaving B cell receptor in a subject, the method comprising administering to the subject a therapeutically effective amount of a polypeptide or composition of any one of embodiments 284-317 to cleave the B cell receptor.

The following examples are illustrative, but not limiting, of the compounds, compositions and methods described herein. Other suitable modifications and adaptations known to those skilled in the art are within the scope of the following embodiments.

EXAMPLES

Example 1: Ides-Fc Polypeptides Exhibit High Yield in a Mammalian Expression System IdeS-Fc polypeptides provided herein were transiently expressed in Expi293 cells. Volumes of 2-5 ul of the supernatants were loaded onto SDS-PAGE or CE-SDS gels to visualize the bands of target proteins. All fusion formats had yields in excess of 100 mg/L. Homo-dimeric formats, including IdeS-Fc, Fc-IdeS, VHH(nanobody)-IdeS-Fc, and Fc-IdeS-VHH(nanobody), had approximately 500 mg/L yield. Knob-in-hole Fc formats produced mixture of correct paired and mis-paired species.

Example 2: Ides-Fc Polypeptides from Mammalian Expression were Catalytically Active Against Human IgG1

IdeS-Fc polypeptides provided herein were transiently expressed in Expi293 cells. Supernatants were incubated with a substrate human IgG1 kappa monoclonal antibody. Samples were loaded onto an SDS-PAGE gel to assess whether IgG1 was cleaved. All fusion formats, except the heavily glycosylated VRT-20, were catalytically active. IdeS with glycosylation knock out mutation at N61 remained active. VRT-20 was engineered to have 9 additional glycosylation sites comparing to wild type IdeS. Thus, the glycan shield blocked its activity.

Example 3: Ides-Fc Polypeptides Exhibit Aggregation in Low pH Elution from ProA Resin Columns Supernatants of Ides-Fc polypeptides from Expi293 expression were loaded onto protein A resin (ProA). Resin was eluted with low pH buffer at pH 2.8-3.3. ProA elution was neutralized with 1M Tris pH 8. Neutralized samples were spun down and the supernatant was loaded onto a 24 mL Superdex 75 size exclusion column. IdeS-Fc polypeptides precipitated heavily during low pH elution from protein A column. The protein A eluates were mainly aggregates on size exclusion column.

In another experiment, 5 mL of supernatants of Ides-Fc polypeptides from Expi293 expression were loaded onto protein A column. Column was eluted with low pH buffer at pH of 2.8-3.3. ProA elution was neutralized with 1M Tris pH 8. Precipitates were spun down and pellets were resuspended for SDS-PAGE. Neutralized samples were run on a SDS-PAGE gel. Inter-molecule disulfide bonds, were observed in the protein A elution fractions. The resuspended precipitates had primarily inter-molecule disulfide linked species.

Example 4: Addition of Arginine and 2-MEA to the Elution Buffer Prevents Precipitation During ProA Purification Supernatants of Ides-Fc polypeptides from Expi293 expression were loaded onto protein A resin (ProA). Resin was eluted with low pH buffer at pH 2.8-3.3, as well as with and without arginine and 2-mercaptoethylamine. ProA elution was neutralized with 1M Tris pH 8. Neutralized samples were spun down and the supernatant was loaded onto a 24 mL Superdex 75 size exclusion column. No precipitation of IdeS-Fc polypeptides was observed when arginine and 2-mercaptoethylamine were included in low pH protein A elution buffer. Eluates arginine and 2-mercaptoethylamine produced more monomeric species on size exclusion column than the elutes with only low pH buffer.

Example 5: SEC Purified Ides-Fc Polypeptides with Optimized Purification Process have Similar Activity to IdeS from *E. coli*

Purified Ides-Fc polypeptides were subjected to Protein A elution and two step purified. Next, samples were incubated with substrate human monoclonal IgG1 at 1:100 Fc fusion: IgG molar ratio, for 4 hours at 37° C. IdeS purified from *E. coli* was assessed side by side, using 1:100 and 1:50 IdeS: IgG molar ratio. Digestion samples were loaded onto a CE-SDS gel to separate the bands of intact IgG (substrate), single cut IgG (intermediate product), and F(ab')2 (final product). Intensity of the target bands were used to visualize the data shown in FIG. 1. Two step purified IdeS-Fc polypeptides displayed similar activity to IdeS alone produced from *E. coli*.

Example 6: Low pH Destabilization of IdeS and IdeS-Fc Polypeptides

Ni-NTA one step purified IdeS and Ides-Fc polypeptides were incubated with different buffers, covering pH range 2.8 to 8. Thermostability and turbidity were measured at temperatures ranging from 25° C. to 90° C. At pH 2.8 to pH 4.5, no phase transition from folded to unfolded was observed on IdeS and IdeS-Fc fusion protein. This indicates the polypeptides were destabilized by low pH. At pH above 6, clear phase transition from folded to unfolded was observed on IdeS and IdeS-Fc fusion protein, with Tm around 50-55° C. This indicates the polypeptides were stable between pH 6 and pH 8.

Example 7: Screening of Excipients Identified Chemicals that Increase Ides-Fc Polypeptide Thermostability Two step purified Ides-Fc polypeptide VRT-5 was incubated with chemicals from two 96 well screening kits (HR2-072 and HR2-413 from Hampton Research). Thermostability and turbidity of each condition were measured at temperatures ranging from 25° C. to 90° C. As shown in the tables below, certain chemicals and buffers were identified to increase thermostability (Tm and Tagg). VRT-5 was more stable at neutral and basic pH, in pH range 4.5 to 9. VRT-5 was more stable at higher sodium chloride concentration in range of 0.05 to 1M. Top 3 chemicals that increased Tm were D-sorbitol, Sucrose, and sodium sulfate. Succinic acid, sodium malonate, DL-malic acid also increased Tm at pH 7.0. Combination of D-sorbitol, Sucrose, and sodium sulfate in one buffer produced synergistic increase of thermo stability.

| Conditions | Tm (° C.) | Tagg (° C.) |
|---|---|---|
| 0.05M Sodium acetate trihydrate pH 4.5, 1M Sodium chloride | 34.98 | 65.25 |
| 0.05M Sodium citrate tribasic dihydrate pH 5.0, 1M Sodium chloride | 50.38 | 81.01 |
| 0.05M Succinic acid pH 5.5, 1M Sodium chloride | 52.83 | 82.31 |
| 0.05M MES monohydrate pH 6.0, 1M Sodium chloride | 49.23 | 78.28 |
| 0.05M BIS-TRIS pH 6.5, 1M Sodium chloride | 52.70 | 81.80 |
| 0.05M Imidazole pH 7.0, 1M Sodium chloride | 53.29 | 81.93 |
| 0.05M HEPES pH 7.5, 1M Sodium chloride | 54.57 | 83.41 |
| 0.05M Tris pH 8.0, 1M Sodium chloride | 54.12 | 83.39 |
| 0.05M BIS-TRIS Propane pH 8.5, 1M Sodium chloride | 53.94 | 83.72 |
| 0.05M AMPD pH 9.0, 1M Sodium chloride | 53.26 | 83.03 |
| 0.05M Glycine pH 9.5, 1M Sodium chloride | 53.41 | 83.48 |

Thermostability of VRT-5 increased as NaCl concentration increased.

| Conditions | Tagg (° C.) | Tagg (° C.) |
|---|---|---|
| Water | 48.76 | 56.74 |
| 0.05M NaCl | 51.05 | 70.25 |
| 0.1M NaCl | 51.82 | 72.05 |
| 0.15M NaCl | 52.24 | 77.97 |
| 0.2M NaCl | 52.35 | 78.98 |
| 0.25M NaCl | 52.59 | 80.17 |
| 0.5M NaCl | 53.42 | 81.91 |
| 1M NaCl | 54.34 | 83.31 |

Thermostability of VRT-5 increased when the chemicals provided in the table below were included in solution.

| Conditions in water | Tm (° C.) | Tagg (° C.) |
|---|---|---|
| Water | 48.76 | 56.74 |
| 1M D-sorbitol | 53.37 | 77.07 |
| 1M sucrose | 54.32 | 82.72 |
| 0.5M sodium sulfate decahydrate | 55.45 | 55.09 |
| 0.5M NaCl | 53.44 | 81.80 |
| 0.25M sodium malonate pH 7.0 | 54.35 | 54.65 |
| 0.25M succinic acid pH 7.0 | 54.71 | 54.49 |
| 0.25M DL-malic acid pH 7.0 | 54.87 | 54.73 |
| 0.375M D-(+)-Trehalose dihydrate | 51.48 | 56.74 |
| 1.25M Betaine monohydrate | 52.35 | 73.38 |
| 1M Xylitol | 52.41 | 82.37 |
| 2.5% v/v Tacsimate pH 7.0 | 52.70 | 75.57 |
| 25% v/v Glycerol | 52.77 | 58.48 |
| 1.25M Trimethylamine N-oxide dihydrate | 54.00 | 84.17 |

Combination of D-sorbitol, Sucrose, and sodium sulfate in one buffer produced synergistic increase of thermo stability.

| Conditions | Excipients | Tm (° C.) | Tagg (° C.) |
|---|---|---|---|
| Water control | None | 47.24 | 56.43 |
| pH 3.5 Glycine 50 mM, 166 mM NaCl | NaCl | 51.76 | 73.15 |
| pH 3.5 Glycine 50 mM, 166 mM NaCl, 350 mM D-sorbitol | NaCl + D-sorbitol | 53.08 | 80.92 |
| pH 3.5 Glycine 50 mM, 166 mM NaCl, 175 mM sodium sulfate decahydrate | NaCl + sodium sulfate decahydrate | 53.17 | 79.79 |
| pH 3.5 Glycine 50 mM, 166 mM NaCl, 350 mM sucrose | NaCl + sucrose | 53.87 | 84.00 |
| pH 3.5 Glycine 50 mM, 166 mM NaCl, 350 mM D-sorbitol, 350 mM sucrose | NaCl + D-sorbitol + sucrose | 54.96 | 85.29 |
| pH 3.5 Glycine 50 mM, 166 mM NaCl, 350 mM D-sorbitol, 175 mM sodium sulfate decahydrate | NaCl + D-sorbitol + sodium sulfate decahydrate | 55.06 | 83.27 |
| pH 3.5 Glycine 50 mM, 166 mM NaCl, 350 mM sucrose, 175 mM sodium sulfate decahydrate | NaCl + sucrose + sodium sulfate decahydrate | 55.44 | 85.22 |
| pH 3.5 Glycine 50 mM, 166 mM NaCl, 350 mM D-sorbitol, 350 mM sucrose, 175 mM sodium sulfate decahydrate | NaCl + D-sorbitol + sucrose + sodium sulfate decahydrate | 56.94 | Too close to 90° C. to be measured |

Example 8: Fc-IdeS Fusion Molecule Exhibits Extended PK and PD In Vivo

Figure 2A:
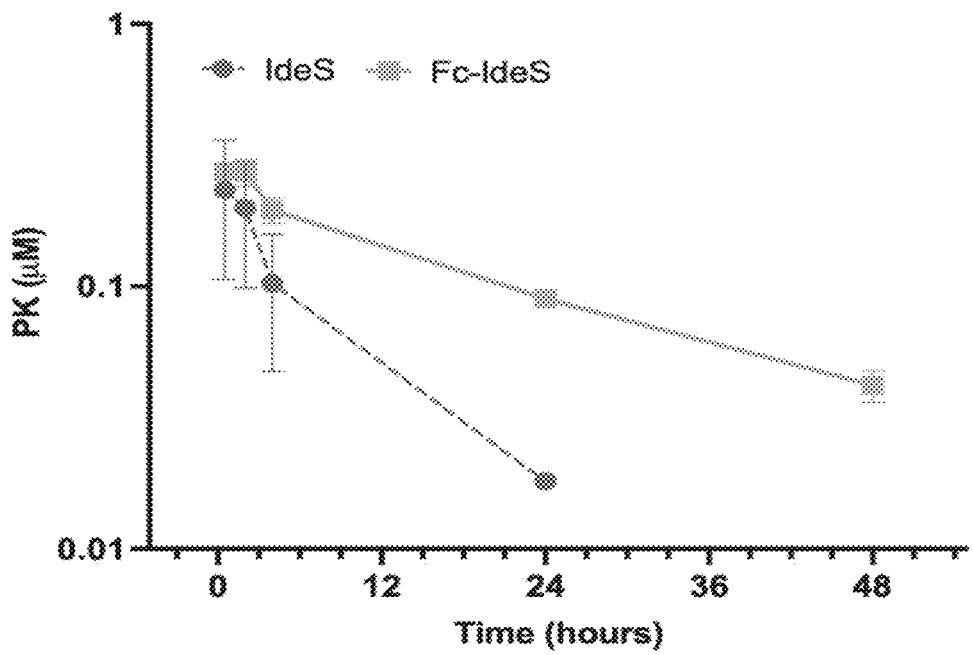
FIG. 2A illustrates PK measurements.
Figure 2B:
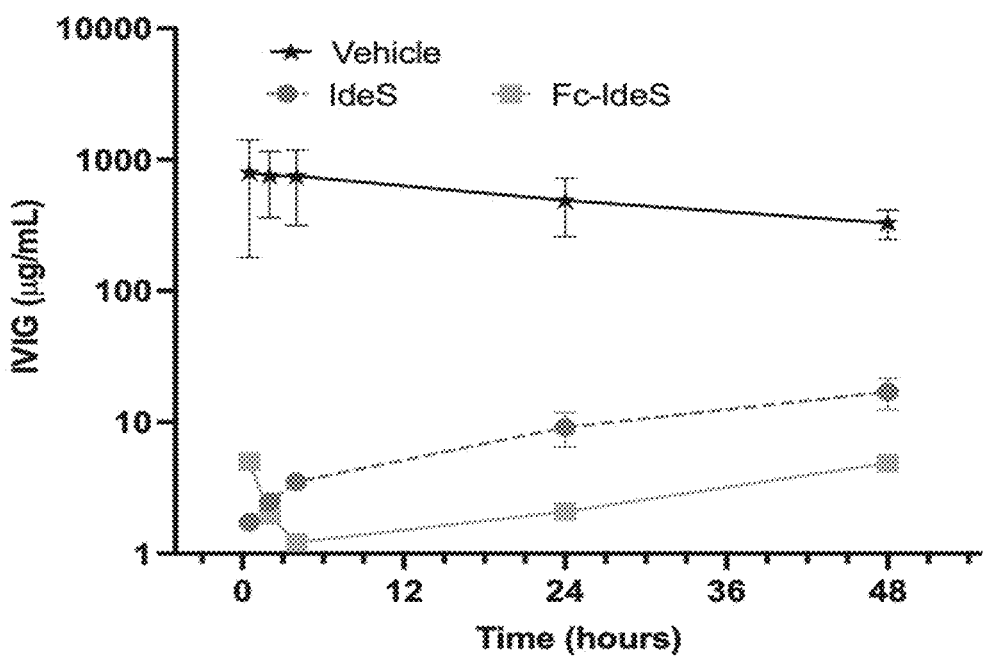
FIG. 2B illustrates PD measurements.

C57BL/6 mice (n=3/group) were injected with human intravenous immunoglobulin (IVIG) and allowed to equilibrate for 24 hours before being injected with the vehicle, IdeS protease (0.5 mg/kg), or the Fc-IdeS fusion molecule (0.9 mg/kg). Mice were euthanized for blood collection at 0 hours, 0.5 hours, 2 hours, 4 hours, 24 hours, and 48 hours following injection of the vehicle, IdeS, or Fc-IdeS. Plasma was collected for exposure analysis and measurement of human IgG levels. Fc-IdeS exhibited extended PK in mice in the presence of human IgG (FIG. 2A), as compared to IdeS. Fc-IdeS also exhibited improved PD as evidence by improved IVIG cleavage (FIG. 2B).

Figure 3:
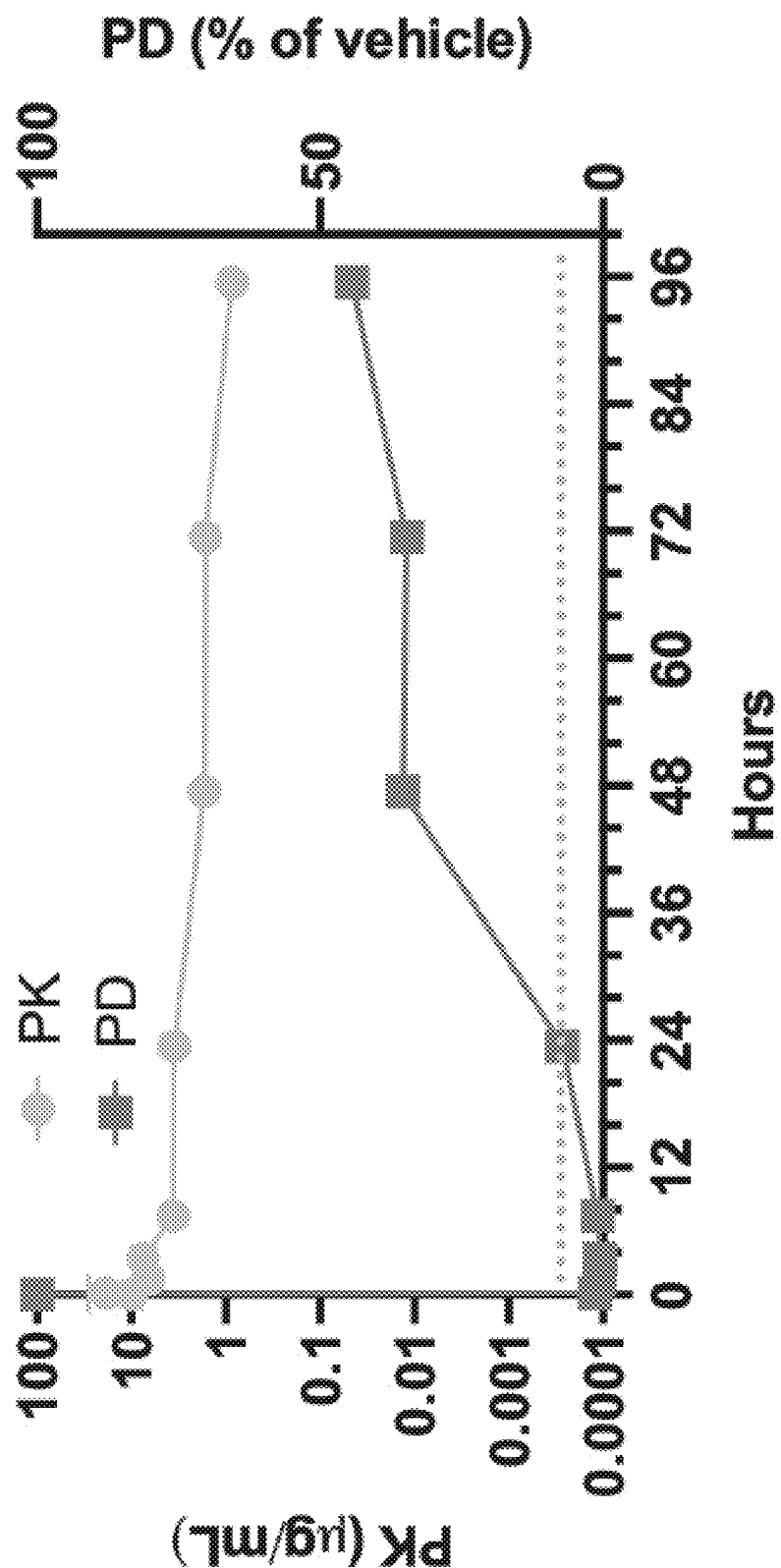
FIG. 3 illustrates PK and PD measurements.
Figure 4A:
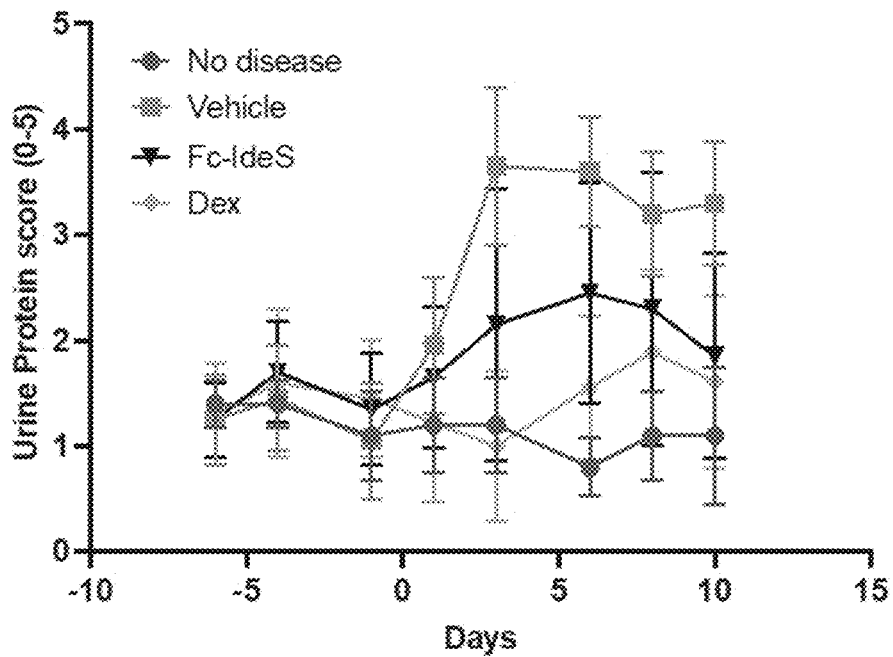
FIG. 4A illustrates urine protein scores.
Figure 4B:
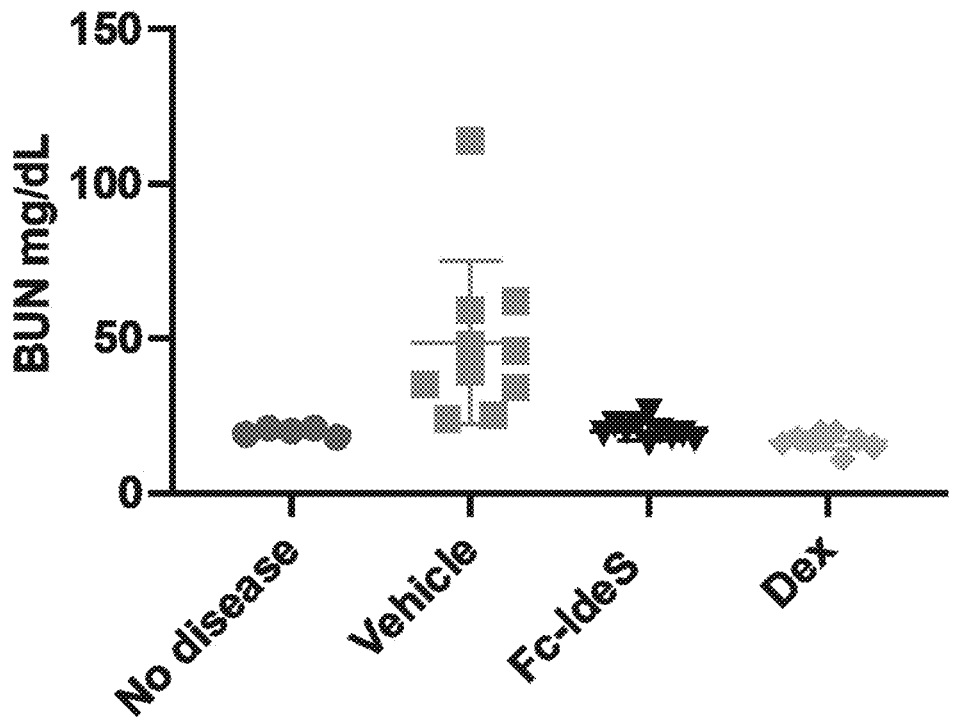
FIG. 4B illustrates urine protein scores.
Figure 4C:
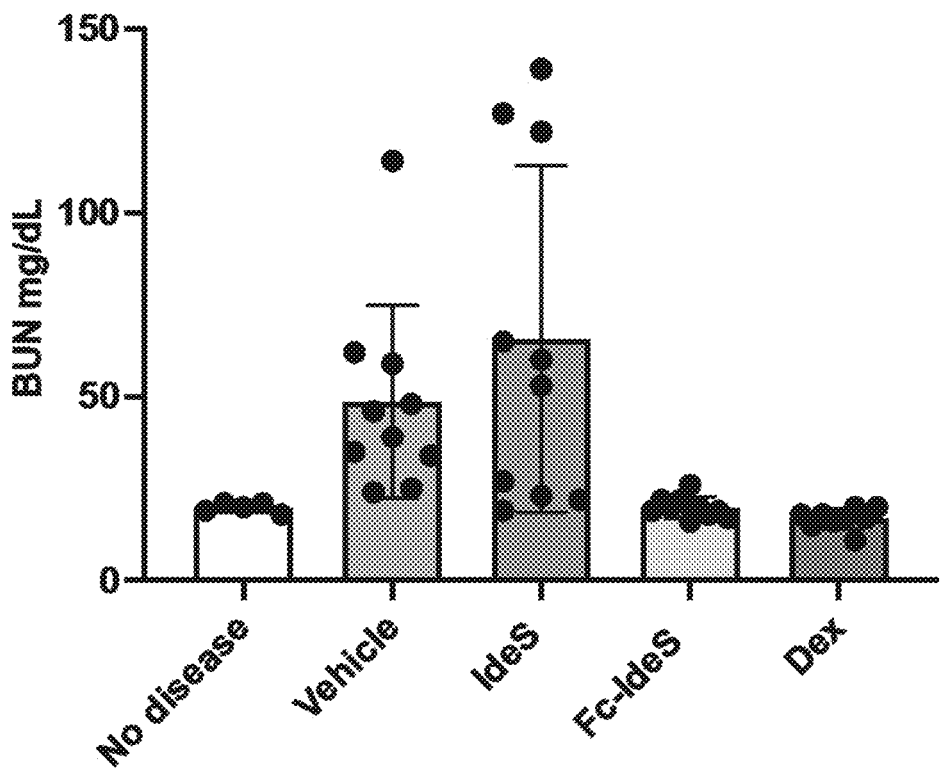
FIG. 4C illustrates blood urea nitrogen levels.
Figure 4D:
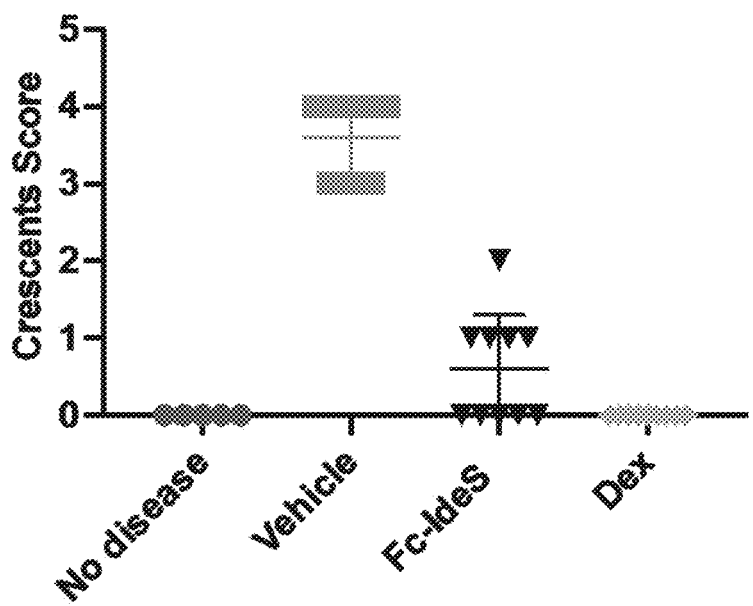
FIG. 4D illustrates analysis of in vivo kidney injury.
Figure 4E:
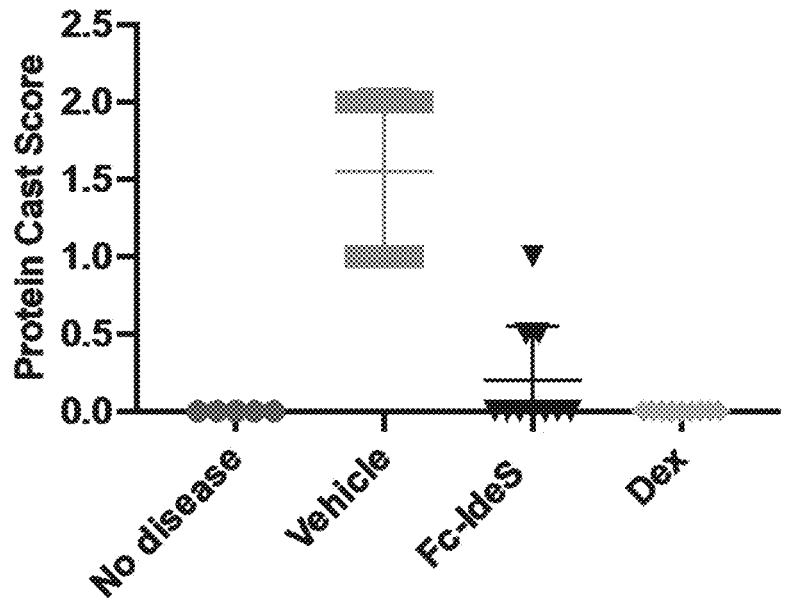
FIG. 4E illustrates analysis of in vivo kidney injury.
Figure 4F:
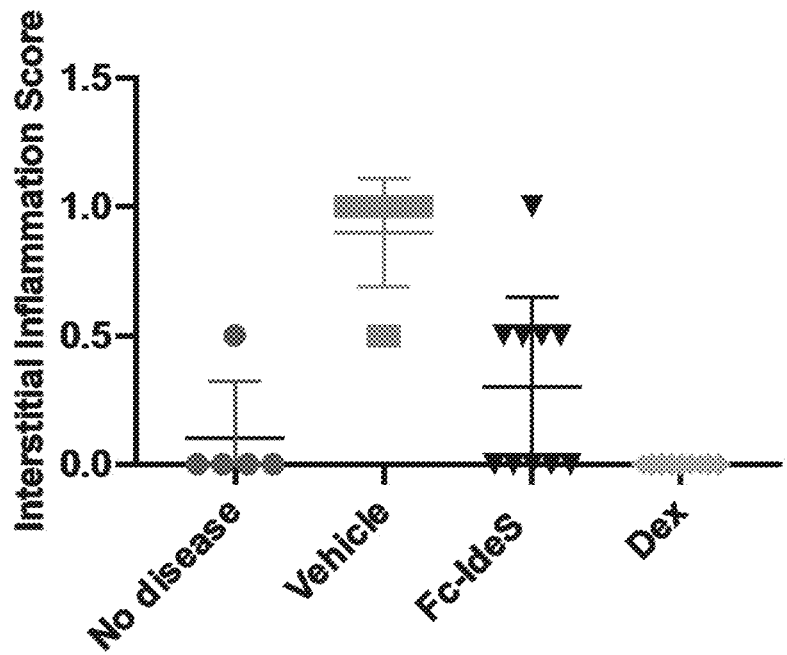
FIG. 4F illustrates analysis of in vivo kidney injury.

Example 9: Fc-IdeS Fusion Molecule Remains Active In Vivo for at Least 4 Days C57BL/6 mice (n=6 for the vehicle treated mice; and n=3 per group for the Fc-IdeS treated mice) were injected intravenously with 0.9 mg/kg Fc-IdeS, followed by injection of human intravenous immunoglobulin (IVIG) at 0.5 hours, 2 hours, 4 hours, 6 hours, 8 hours, 24 hours, 48 hours, 72 hours, or 96 hours following Fc-IdeS injection. Blood was first collected 15 minutes prior to injection of IVIG for PK determination, and mice were euthanized 2 hours after IVIG injection for PD measurements. Fc-IdeS exhibited extended PK in mice (FIG. 3). PD analysis showed reduced human IgG level even 4 days following injection with Fc-IdeS, illustrating that Fc-IdeS remained active 4 days after injection in mice (FIG. 3).

Example 10: Fc-IdeS Demonstrates Efficacy in an IgG Immune Complex-Mediated Kidney Disease In Vivo Model Without wishing to be bound to a particular theory, pathology in the anti-GBM (glomerular basement membrane) mouse model of kidney disease is driven by immune complex deposition in the kidneys. Immune complexes bind to the glomerular basement membrane in the kidney, inducing tissue damage via complement activation, proteinuria and an increase in blood urea nitrogen (BUN). Fc-IdeS was used to treat the disease by cleaving sheep IgG immune complexes prophylactically. In brief, female 129/SvJ mice (n=10 per group) were sensitized by immunization with sheep IgG (IP injection) followed by injection of sheep ant-rat GBM serum (which is cross-reactive to mouse GBM) five days following immunization. At 4 days following immunization, mice were intravenously injected with 8 mg/kg Fc-IdeS, a vehicle, or dexamethasone (dex). Mice were euthanized 15 days following immunization. Plasma PK was measured at days 5 and 15 following immunization. Proteinuria was measured the day before immunization and at days 1, 4, 6, 8, 11, 13, and 15 following immunization. Blood urea nitrogen (BUN) was measured at day 15 following immunization. Additionally, kidney histology was assessed at day 15 following immunization. Prophylactic treatment with Fc-IdeS prevented immune complex-driven proteinuria and increase in blood urea nitrogen (BUN), as shown in FIGS. 4A-4F.

Example 11: Fc-IdeS Demonstrates Ability to Cleave B Cell Receptors

Figure 5A:
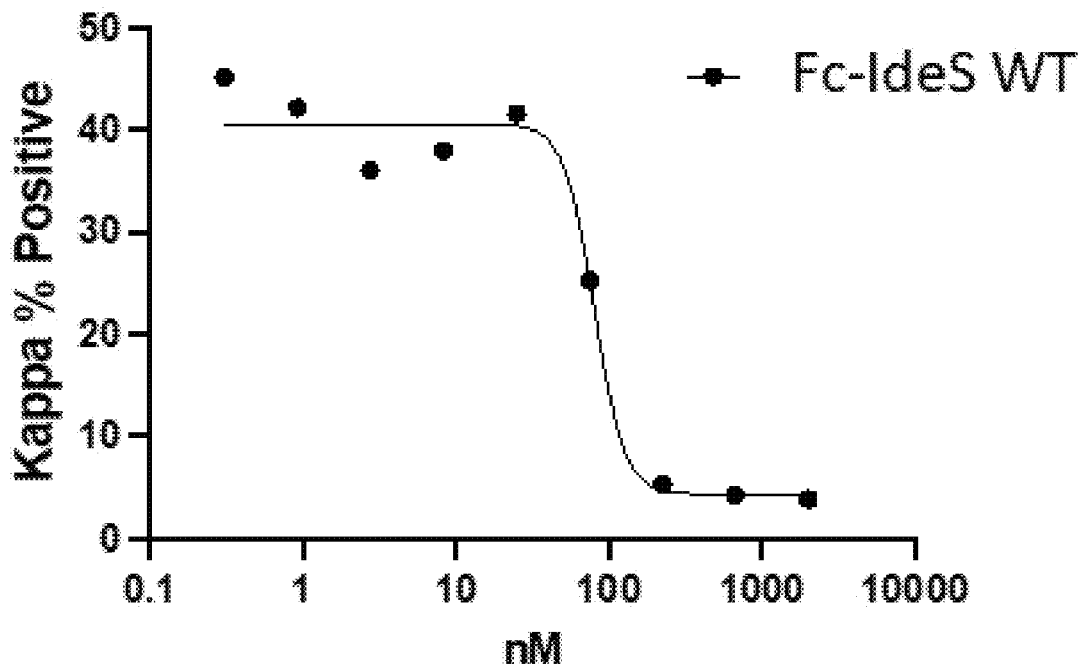
FIG. 5A illustrates analysis of B cell receptor kappa cleavage.
Figure 5B:
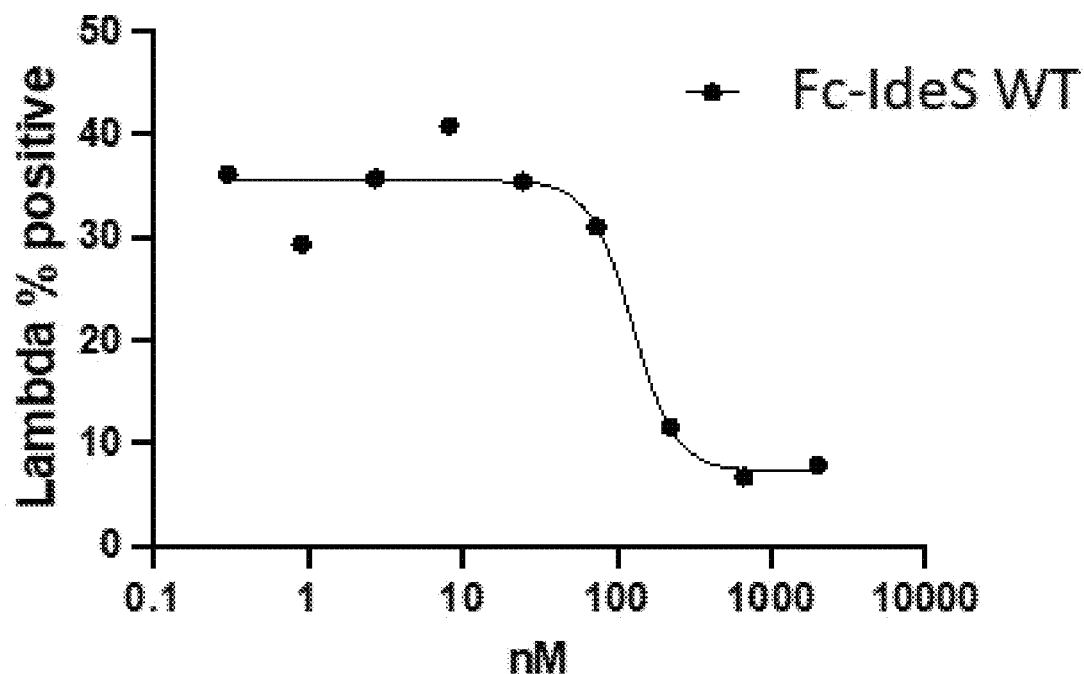
FIG. 5B illustrates analysis of B cell receptor lambda cleavage.

Whole blood was collected in NA heparin tubes and plated in a 96 well round bottom plate varying doses of Fc-IdeS. Dose ranges from 2000 nM to 0.3 nM. The blood and protease were incubated at 37° C. and 5% CO2 for 20 hours. The blood was lysed and the cells were stained with antibodies for CD20, IgM, IgD, IgG, Kappa and Lambda. Cells were acquired on the attune and analyzed in Flow Jo. Treatment of human whole blood with Fc-IdeS lead to a dose dependent decrease in the expression of kappa and lambda light chains, as shown below and in FIGS. 5A-5B.

| Light chain | EC50 Fc-IdeS |
|---|---|
| Kappa | 80 nM |
| Lambda | 127 nM |

Example 12: Characterization of Polypeptides Having Protease Activity and Fusions of Said Polypeptides to Fc Moieties Mutant proteases were designed using advanced machine learning based algorithms centered around learning residue epistasis from natural protease sequences to allow for mutagenesis of B cell epitopes, predicted T cell epitopes, predicted chemical liabilities, whilst maintaining enzyme activity and either maintaining or increasing thermostability.

Purification and Quantification of Polypeptides Produced in *E. coli*

Gene synthesis and standard cloning techniques were used to create *E. coli* (pET29b) expression vectors for each of the designed proteases. Vectors were sequence verified by Sanger sequencing prior to transformation. Proteases cloned in pET29b were transformed into *E. coli* (BL21 Star) using standard procedures. The transformed *E. coli* were outgrown in SOC media, transferred to LB media overnight to scale up for starter culture that was inoculated into ZYM5052 auto-induction media. Scaled up cultures were incubated with aeration for 4 hrs at 37° C. and then 18 hrs at 20° C. *E. coli* pellets were harvested by centrifugation and a lysozyme/DNAse mixture used for lysis. Lysate was isolated via centrifugation and then fed into the purification protocol. For *E. coli* production, after lysing of the bacterial pellet, 25 μL of the whole cell lysate was collected for analysis. The lysed culture was then spun down for 30 min at 4000 rcf and supernatant was moved to a new plate. 25 μL of clarified lysate was saved. The clarified lysate was purified with Ni-NTA resin and the eluted protein was buffer exchanged to PBS (pH 7.4). Samples of (1) whole cell lysate, (2) soluble lysate and (3) purified protein were analyzed by CE-SDS, and concentrations were calculated by comparing to a standard dilution of IdeS protease. Expression titer was from the whole cell lysate concentration, and percent soluble was calculated by dividing the (2) soluble lysate concentration by the (1) whole cell lysate concentration. Polypeptides having protease activity exhibited a variety of expression levels ranging from less than, equal to, or more than the parental proteases, as shown in Tables 9, 10, and 11 below.

Expression and Purification of Polypeptides Produced in Mammalian Cells

Gene synthesis and standard cloning techniques were used to create mammalian (pcDNA3.4) expression vectors for each of the designed Fc fusions. Mammalian expression vectors were transfected into Expi293 or ExpiCHO cells using expifectamine transfection kits from Thermo Scientific following standard manufacturers protocol. Transfection supernatant was clarified by Day 5 after transfection (HEK cells), Day 7 after transfection (CHO cells), or once cell viability dropped to 80-85%, whichever occurred sooner. Clarified supernatant was filtered using a 0.22 μm filter for sterilization prior to purification. For mammalian cell production, the expression titer was measured directly from the supernatant, with a control antibody as a standard titration. Protease-Fc fusions were purified from the harvested supernatant using protein A based affinity chromatography on an AKTA FPLC. Purified protein was formulated into PBS pH 7.4. Variant protease-Fc fusions exhibited a variety of expression levels ranging from less than, equal to, or more than the parental protease Fc fusion, as shown in Tables 14, 15, and 16 below.

Enzyme Activity Endpoint Assay

The buffer exchanged protease produced from E. coli was normalized to 0.1 and 0.2 mg/ml. 1 μL of sample polypeptide having protease activity was mixed with 2 μL of human IgG1, 2, 3 and 4 (0.4 mg/ml) and incubated at 37° C. for 4 hrs. After 4 hrs, 7 μL of Sample buffer (containing 8 μM iodoacetamide) was added with mixing to quench the reaction. Samples were run on CE-SDS. For mammalian produced proteases, 2 μL of supernatant was used in the endpoint assay. The data shown in Tables 14, 15, and 16 illustrates that many polypeptides having protease activity retained the same level of proteolytic activity as the respective parental proteases, or even exhibited increased activity.

Thermostability Measurements

From the experimental group comprising 0.2 mg/ml normalized samples, 10 μL of each sample was loaded into a capillary and Tm was measured by intrinsic nanoDSF using a Prometheus Panta. The analysis identified a number of polypeptides having protease activity with higher Tm than the parental protease, as shown in Tables 14 and 15.

TABLE 14

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| huIgG_cntrl1 | | | 0 | 0 | 0 | 140 | |
| PRT-CNTRL | 4 | 121 | 127 | 48 | 16 | 14 | 55 |
| PRT-1 | 3 | 63 | 100 | 44 | 21 | 23 | 55 |
| PRT-2 | 3 | 56 | 94 | 47 | 0 | 21 | 52 |
| PRT-3 | 3 | 61 | 72 | 14 | 33 | 11 | 53 |
| PRT-4 | 5 | 36 | 97 | 21 | 42 | 23 | 62 |
| PRT-5 | 4 | 74 | 117 | 34 | 34 | 18 | 57 |
| PRT-6 | 4 | 80 | 129 | 49 | 15 | 16 | 59 |
| PRT-7 | 5 | 145 | 137 | 50 | 16 | 18 | 59 |
| PRT-8 | 5 | 128 | 127 | 50 | 16 | 16 | 57 |
| PRT-9 | 3 | 38 | 103 | 39 | 32 | 21 | 61 |
| PRT-10 | 3 | 68 | 56 | 2 | 58 | 32 | 59 |
| PRT-11 | 4 | 78 | 100 | 40 | 0 | 13 | 58 |
| PRT-12 | 4 | 65 | 122 | 47 | 14 | 16 | 53 |
| PRT-13 | 4 | 93 | 74 | 2 | 66 | 12 | 57 |
| PRT-14 | 3 | 109 | 94 | 18 | 43 | 13 | 52 |
| PRT-15 | 3 | 88 | 136 | 52 | 17 | 18 | 54 |
| PRT-16 | 4 | 97 | 0 | 0 | 0 | 151 | Not determined |
| PRT-17 | 3 | 79 | 116 | 53 | 0 | 34 | 53 |
| PRT-18 | 4 | 97 | 105 | 44 | 11 | 12 | 54 |
| PRT-19 | 5 | 99 | 108 | 42 | 13 | 13 | 53 |
| PRT-20 | 4 | 104 | 124 | 48 | 13 | 15 | 54 |
| PRT-21 | 3 | 87 | 111 | 33 | 28 | 23 | 57 |
| PRT-22 | 4 | 105 | 116 | 37 | 23 | 19 | 58 |
| PRT-23 | 4 | 107 | 125 | 45 | 19 | 12 | 58 |
| PRT-24 | 5 | 117 | 131 | 52 | 16 | 18 | 57 |
| PRT-25 | 3 | 65 | 123 | 56 | 0 | 20 | 57 |
| PRT-26 | 3 | 114 | 101 | 40 | 14 | 11 | 57 |
| PRT-27 | 4 | 94 | 112 | 44 | 13 | 14 | 54 |
| PRT-28 | 4 | 102 | 89 | 16 | 44 | 14 | 54 |
| PRT-29 | 3 | 65 | 95 | 19 | 43 | 27 | 53 |
| PRT-30 | 3 | 128 | 73 | 3 | 65 | 21 | 54 |
| PRT-31 | 3 | 106 | 126 | 46 | 15 | 13 | 55 |
| PRT-32 | 4 | 120 | 124 | 48 | 17 | 14 | 56 |
| PRT-33 | 3 | 83 | 93 | 26 | 44 | 17 | 54 |
| PRT-34 | 3 | 102 | 95 | 37 | 14 | 10 | 56 |
| PRT-35 | 5 | 103 | 104 | 37 | 14 | 9 | 55 |
| PRT-36 | 4 | 127 | 123 | 48 | 16 | 15 | 55 |
| PRT-37 | 3 | 112 | 79 | 4 | 69 | 23 | 55 |
| PRT-38 | 3 | 111 | 124 | 46 | 15 | 14 | 54 |
| PRT-39 | 5 | 121 | 116 | 39 | 19 | 9 | 54 |
| PRT-40 | 4 | 110 | 108 | 42 | 13 | 14 | 53 |
| PRT-41 | 4 | 71 | 94 | 24 | 50 | 19 | 55 |
| PRT-42 | 3 | 72 | 54 | 0 | 53 | 26 | 55 |
| PRT-43 | 6 | 90 | 89 | 23 | 32 | 13 | 56 |
| PRT-44 | 4 | 95 | 78 | 3 | 60 | 14 | 49 |
| PRT-45 | 4 | 114 | 76 | 3 | 67 | 8 | 52 |
| PRT-46 | 3 | 137 | 101 | 20 | 39 | 15 | 50 |
| PRT-47 | 5 | 131 | 5 | 0 | 0 | 132 | 52 |
| PRT-48 | 4 | 73 | 5 | 0 | 0 | 141 | 46 |
| PRT-49 | 1 | 99 | 96 | 30 | 40 | 18 | 54 |
| PRT-50 | Not determined | 72 | 5 | 0 | 0 | 135 | 58 |
| PRT-51 | 5 | 109 | 11 | 0 | 0 | 118 | 55 |

TABLE 14-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-52 | 6 | 104 | 12 | 0 | 0 | 122 | 49 |
| PRT-53 | Not determined | 96 | 84 | 7 | 61 | 9 | 55 |
| PRT-54 | 3 | 117 | 24 | 0 | 10 | 110 | 50 |
| PRT-55 | 3 | 153 | 70 | 0 | 57 | 19 | 51 |
| PRT-56 | 4 | 123 | 13 | 0 | 3 | 125 | 51 |
| PRT-57 | 4 | 85 | 52 | 0 | 55 | 44 | 51 |
| PRT-58 | 3 | 128 | 9 | 0 | 1 | 125 | 59 |
| PRT-59 | Not determined | 104 | 70 | 6 | 56 | 8 | 54 |
| PRT-60 | 3 | 117 | 133 | 52 | 16 | 16 | 54 |
| PRT-61 | 4 | 118 | 55 | 0 | 50 | 52 | 53 |
| PRT-62 | 3 | 133 | 94 | 15 | 56 | 8 | 55 |
| PRT-63 | 3 | 125 | 120 | 44 | 19 | 13 | 51 |
| PRT-64 | 4 | 99 | 123 | 50 | 17 | 16 | 55 |
| PRT-65 | 3 | 91 | 100 | 35 | 34 | 26 | 53 |
| PRT-66 | 3 | 116 | 115 | 49 | 13 | 15 | 55 |
| PRT-67 | Not determined | 114 | 78 | 10 | 61 | 23 | 51 |
| PRT-68 | 4 | 107 | 133 | 51 | 16 | 16 | 53 |
| PRT-69 | 3 | 81 | 121 | 45 | 14 | 14 | 55 |
| PRT-70 | 4 | 85 | 124 | 47 | 14 | 14 | 55 |
| PRT-71 | 3 | 88 | 126 | 53 | 0 | 25 | 56 |
| PRT-72 | 3 | 95 | 100 | 41 | 8 | 14 | 57 |
| PRT-73 | 3 | 93 | 105 | 52 | 5 | 28 | 54 |
| PRT-74 | 2 | 20 | 73 | 26 | 27 | 23 | 57 |
| PRT-75 | 5 | 108 | 76 | 12 | 54 | 8 | 55 |
| PRT-76 | 2 | 49 | 78 | 20 | 38 | 37 | 53 |
| PRT-77 | 3 | 77 | 104 | 33 | 17 | 14 | 53 |
| PRT-78 | 4 | 122 | 94 | 34 | 11 | 21 | 56 |
| PRT-79 | 9 | 87 | 44 | 0 | 38 | 72 | 59 |
| PRT-80 | 5 | 97 | 70 | 15 | 34 | 29 | 61 |
| PRT-81 | 2 | 14 | 67 | 14 | 56 | 30 | 54 |
| PRT-82 | Not determined | 62 | 67 | 9 | 60 | 15 | 56 |
| PRT-83 | 5 | 83 | 44 | 0 | 40 | 42 | 54 |
| PRT-84 | 4 | 97 | 67 | 8 | 51 | 27 | 56 |
| PRT-85 | 3 | 60 | 0 | 0 | 0 | 109 | 51 |
| PRT-86 | 3 | 76 | 61 | 4 | 53 | 45 | 47 |
| PRT-87 | 4 | 102 | 52 | 0 | 50 | 60 | 54 |
| PRT-88 | 3 | 85 | 110 | 48 | 0 | 25 | 55 |
| PRT-89 | 2 | 57 | 89 | 45 | 0 | 34 | 55 |
| PRT-90 | 3 | 60 | 106 | 44 | 0 | 21 | 56 |
| PRT-91 | 5 | 96 | 102 | 40 | 9 | 16 | 56 |
| PRT-92 | 3 | 62 | 104 | 40 | 6 | 8 | 55 |
| PRT-93 | 3 | 79 | 91 | 38 | 0 | 11 | 53 |
| huIgG_cntrl1 | | not found | 0 | 0 | 0 | 1159 | |
| PRT-CNTRL | 5 | 107 | 196 | 732 | 0 | 0 | 55 |
| PRT-94 | 12 | 100 | 120 | 547 | 0 | 0 | 54 |
| PRT-95 | 14 | 108 | 118 | 242 | 0 | 102 | 53 |
| PRT-96 | 10 | 77 | 156 | 482 | 0 | 0 | 52 |
| PRT-97 | 8 | 77 | 185 | 524 | 0 | 0 | 53 |
| PRT-98 | 12 | 86 | 180 | 592 | 0 | 0 | 53 |
| PRT-99 | 12 | 78 | 152 | 489 | 0 | 0 | 55 |
| PRT-100 | 11 | 81 | 178 | 513 | 0 | 0 | 53 |
| PRT-101 | 12 | 84 | 204 | 655 | 0 | 0 | 53 |
| PRT-102 | Not determined | 86 | 160 | 607 | 0 | 0 | 51 |
| PRT-103 | 13 | 100 | 158 | 544 | 0 | 0 | 53 |
| PRT-104 | 16 | 102 | 130 | 259 | 0 | 0 | 53 |
| PRT-105 | 8 | 94 | 192 | 663 | 13 | 0 | 53 |
| PRT-106 | 11 | 89 | 202 | 739 | 0 | 0 | 52 |
| PRT-107 | 5 | 65 | 200 | 553 | 117 | 0 | 55 |
| PRT-108 | 14 | 112 | 203 | 666 | 0 | 0 | 56 |
| PRT-109 | 11 | 86 | 181 | 457 | 0 | 28 | 61 |
| PRT-110 | 15 | 131 | 136 | 575 | 0 | 0 | 58 |
| PRT-111 | 12 | 130 | 133 | 328 | 0 | 26 | 56 |
| PRT-112 | 6 | 90 | 152 | 435 | 0 | 15 | 59 |
| PRT-113 | 5 | 67 | 189 | 656 | 0 | 0 | 51 |
| PRT-114 | 4 | 98 | 162 | 361 | 111 | 129 | 58 |
| PRT-115 | 11 | 96 | 128 | 124 | 105 | 24 | 58 |
| PRT-116 | 4 | 70 | 188 | 510 | 0 | 0 | 56 |
| PRT-117 | 8 | 71 | 207 | 663 | 0 | 0 | 54 |
| PRT-118 | 2 | 56 | 85 | 23 | 153 | 0 | 56 |
| PRT-119 | 15 | 127 | 96 | 15 | 133 | 0 | 63 |
| PRT-120 | 6 | 99 | 113 | 92 | 153 | 28 | 54 |
| PRT-121 | 5 | 55 | 174 | 447 | 0 | 0 | 61 |
| PRT-122 | 9 | 101 | 194 | 565 | 0 | 138 | 50 |
| PRT-123 | 5 | 65 | 187 | 468 | 0 | 0 | 61 |

TABLE 14-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-124 | 6 | 92 | 202 | 676 | 0 | 0 | 56 |
| PRT-125 | 10 | 100 | 197 | 609 | 0 | 0 | 56 |
| PRT-126 | 13 | 112 | 160 | 472 | 0 | 0 | 56 |
| PRT-127 | Not determined | 111 | 140 | 523 | 0 | 0 | 59 |
| PRT-128 | 13 | 107 | 151 | 560 | 60 | 0 | 60 |
| PRT-129 | 14 | 122 | 169 | 384 | 0 | 0 | 55 |
| PRT-130 | 10 | 115 | 192 | 592 | 0 | 0 | 53 |
| PRT-131 | 5 | 104 | 201 | 745 | 0 | 0 | 55 |
| PRT-132 | 11 | 32 | 219 | 697 | 0 | 0 | 57 |
| PRT-133 | 11 | 89 | 207 | 774 | 12 | 0 | 54 |
| PRT-134 | 14 | 102 | 174 | 597 | 0 | 0 | 55 |
| PRT-135 | 14 | 115 | 140 | 526 | 6 | 0 | 55 |
| PRT-136 | 14 | 109 | 160 | 635 | 0 | 0 | 55 |
| PRT-137 | Not determined | 99 | 198 | 662 | 0 | 0 | 54 |
| PRT-138 | 16 | 157 | 215 | 563 | 144 | 0 | 55 |
| PRT-139 | 10 | 96 | 213 | 733 | 0 | 0 | 55 |
| PRT-140 | 5 | 93 | 213 | 755 | 0 | 0 | 53 |
| PRT-141 | 9 | 92 | 215 | 846 | 0 | 0 | 53 |
| PRT-142 | 13 | 151 | 135 | 589 | 0 | 0 | 54 |
| PRT-143 | 7 | 103 | 170 | 576 | 0 | 0 | 53 |
| PRT-144 | 12 | 119 | 151 | 562 | 26 | 0 | 50 |
| PRT-145 | 11 | 101 | 207 | 735 | 0 | 0 | 49 |
| PRT-146 | 7 | 124 | 215 | 672 | 0 | 0 | 50 |
| PRT-147 | 10 | 108 | 206 | 723 | 0 | 0 | 45 |
| PRT-148 | 8 | 87 | 203 | 764 | 0 | 0 | 52 |
| PRT-149 | 5 | 87 | 0 | 831 | 0 | 0 | 50 |
| PRT-150 | 5 | 73 | 161 | 612 | 0 | 0 | 52 |
| PRT-151 | 7 | 103 | 137 | 521 | 0 | 0 | 50 |
| PRT-152 | 8 | 82 | 158 | 614 | 0 | 0 | 55 |
| PRT-153 | 16 | 106 | 190 | 619 | 0 | 0 | 53 |
| PRT-154 | 15 | 136 | 191 | 733 | 0 | 0 | 53 |
| PRT-155 | 9 | 124 | 197 | 751 | 18 | 0 | 52 |
| PRT-156 | 8 | 112 | 205 | 772 | 0 | 0 | 55 |
| PRT-157 | 8 | 105 | 198 | 806 | 0 | 0 | 54 |
| PRT-158 | 14 | 94 | 163 | 637 | 0 | 0 | 54 |
| PRT-159 | 15 | 103 | 184 | 637 | 0 | 0 | 56 |
| PRT-160 | 6 | 61 | 168 | 642 | 0 | 0 | 50 |
| PRT-161 | 13 | 100 | 172 | 669 | 0 | 0 | 46 |
| PRT-162 | 9 | 122 | 196 | 729 | 0 | 0 | 55 |
| PRT-163 | 12 | 103 | 184 | 706 | 0 | 29 | 55 |
| PRT-164 | 13 | 69 | 203 | 508 | 85 | 0 | 55 |
| PRT-165 | 13 | 81 | 204 | 783 | 0 | 0 | 54 |
| PRT-166 | 12 | 60 | 161 | 597 | 0 | 0 | 55 |
| PRT-167 | 14 | 94 | 161 | 572 | 0 | 0 | 56 |
| PRT-168 | 13 | 68 | 159 | 628 | 0 | 0 | 56 |
| PRT-169 | 5 | 66 | 188 | 658 | 0 | 0 | 55 |
| PRT-170 | 13 | 119 | 193 | 755 | 0 | 0 | 55 |
| PRT-171 | 7 | 63 | 187 | 765 | 0 | 23 | 57 |
| PRT-172 | 13 | 82 | 215 | 821 | 0 | 0 | 55 |
| PRT-173 | 5 | 71 | 226 | 912 | 30 | 0 | 52 |
| PRT-174 | 14 | 111 | 160 | 586 | 0 | 0 | 51 |
| PRT-175 | 15 | 86 | 147 | 497 | 0 | 0 | 51 |
| PRT-176 | 7 | 22 | 140 | 310 | 86 | 0 | 38 |
| PRT-177 | 12 | 13 | 105 | 67 | 426 | 131 | 37 |
| PRT-178 | 3 | 136 | 196 | 695 | 0 | 0 | 56 |
| PRT-179 | 5 | 73 | 187 | 697 | 0 | 0 | 56 |
| PRT-180 | 6 | 78 | 197 | 690 | 0 | 0 | 53 |
| PRT-181 | 5 | 51 | 217 | 890 | 0 | 24 | 58 |
| PRT-182 | Not determined | 80 | 167 | 563 | 27 | 0 | 53 |
| PRT-183 | 13 | 67 | 175 | 630 | 0 | 0 | 55 |
| PRT-184 | 6 | 52 | 165 | 629 | 0 | 0 | 54 |
| PRT-185 | Not determined | 11 | 45 | 0 | 152 | 365 | 48 |
| PRT-186 | 6 | 119 | 218 | 646 | 0 | 9 | 54 |
| huIgG_cntrl1 | | 0 not found | 0 | 0 | 0 | 1320 | |
| PRT-CNTRL | 8.1 | 57 | 297 | 238 | 210 | 0 | 55 |
| PRT-187 | 4.9 | 59 | 307 | 265 | 103 | 115 | 55 |
| PRT-188 | 8.5 | 61 | 40 | 0 | 25 | 905 | 47 |
| PRT-189 | 6.4 | 74 | 307 | 469 | 101 | 0 | 49 |
| PRT-190 | 7.0 | 66 | 278 | 323 | 145 | 76 | 50 |
| PRT-191 | 8.2 | 45 | 183 | 36 | 358 | 161 | 56 |
| PRT-192 | 7.9 | 73 | 204 | 24 | 461 | 109 | 48 |
| PRT-193 | 7.8 | 79 | 193 | 39 | 355 | 181 | 49 |
| PRT-194 | 7.0 | 50 | 12 | 0 | 0 | 301 | 44 |

TABLE 14-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-195 | 7.3 | 74 | 30 | 0 | 15 | 829 | 44 |
| PRT-196 | Not determined | 38 | 498 | 152 | 504 | 707 | 52 |
| PRT-197 | Not determined | 80 | 179 | 0 | 121 | 1802 | 55 |
| PRT-198 | Not determined | 0 | 0 | 621 | 0 | 2324 | Not determined |
| PRT-199 | Not determined | 50 | 473 | 95 | 544 | 797 | 62 |
| PRT-200 | Not determined | 0 | 0 | 0 | 0 | 2506 | Not determined |
| PRT-201 | Not determined | 23 | 0 | 0 | 0 | 2721 | 60 |
| PRT-202 | Not determined | 81 | 402 | 25 | 553 | 1131 | 55 |
| PRT-203 | Not determined | 0 | 0 | 0 | 0 | 2129 | Not determined |
| PRT-204 | Not determined | 0 | 0 | 0 | 0 | 2259 | Not determined |
| PRT-205 | Not determined | 41 | 216 | 127 | 278 | 1086 | 54 |
| PRT-206 | Not determined | 0 | 0 | 570 | 0 | 2130 | Not determined |
| PRT-207 | Not determined | 49 | 249 | 0 | 287 | 1288 | 58 |
| PRT-208 | Not determined | 64 | 153 | 0 | 113 | 1703 | 51 |
| PRT-209 | Not determined | 49 | 124 | 0 | 71 | 1666 | 58 |
| PRT-210 | Not determined | 24 | 87 | 0 | 25 | 1779 | 62 |
| PRT-211 | Not determined | 64 | 68 | 0 | 0 | 2187 | 59 |
| PRT-212 | Not determined | 18 | 435 | 13 | 599 | 1273 | 59 |
| PRT-213 | Not determined | 51 | 244 | 0 | 301 | 1290 | 59 |
| PRT-214 | Not determined | 38 | 27 | 467 | 0 | 1654 | 65 |
| PRT-215 | Not determined | 125 | 310 | 73 | 309 | 708 | 58 |
| PRT-216 | Not determined | 46 | 0 | 0 | 0 | 1665 | 43 |
| PRT-217 | Not determined | 76 | 86 | 0 | 41 | 1584 | 62 |
| PRT-218 | Not determined | 45 | 39 | 0 | 0 | 1783 | 60 |
| PRT-219 | Not determined | 60 | 407 | 104 | 443 | 886 | 60 |
| PRT-220 | Not determined | 30 | 61 | 0 | 0 | 2319 | 60 |
| PRT-221 | Not determined | 81 | 439 | 117 | 461 | 653 | 55 |
| PRT-222 | Not determined | 47 | 78 | 487 | 21 | 1551 | 55 |
| PRT-223 | Not determined | 15 | 391 | 189 | 316 | 375 | 55 |
| PRT-224 | Not determined | 60 | 382 | 217 | 314 | 344 | 56 |
| PRT-225 | Not determined | 57 | 63 | 0 | 0 | 1503 | 54 |
| PRT-226 | Not determined | 66 | 0 | 0 | 0 | 1960 | 55 |
| PRT-227 | Not determined | 36 | 331 | 22 | 492 | 880 | 54 |
| PRT-228 | Not determined | 47 | 583 | 195 | 557 | 767 | 49 |
| PRT-229 | Not determined | 1 | 243 | 691 | 294 | 1272 | 56 |
| PRT-230 | Not determined | 39 | 454 | 699 | 396 | 513 | 53 |
| PRT-231 | Not determined | 58 | 388 | 176 | 313 | 465 | 51 |
| PRT-232 | Not determined | 34 | 283 | 40 | 393 | 624 | 55 |
| PRT-233 | Not determined | 39 | 376 | 94 | 415 | 596 | 52 |
| PRT-234 | Not determined | 28 | 376 | 88 | 432 | 640 | 54 |
| PRT-235 | Not determined | 20 | 448 | 116 | 483 | 711 | 51 |
| PRT-236 | Not determined | 28 | 615 | 294 | 472 | 594 | 51 |
| PRT-237 | Not determined | 31 | 415 | 828 | 461 | 685 | 53 |
| PRT-238 | Not determined | 11 | 81 | 0 | 28 | 1613 | 56 |
| PRT-239 | Not determined | 14 | 269 | 49 | 360 | 689 | 49 |
| PRT-240 | Not determined | 3 | 82 | 0 | 36 | 1396 | 42 |

TABLE 15

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| huIgG1, 2, 3, 4 | | | 0 | 0 | 0 | 1818.87 | — |
| Ide85 | | | 615 | 1130 | 0 | 0 | — |
| IdeS | | | 524 | 1355 | 0 | 0 | — |
| IdeZ | | | 481 | 1293 | 0 | 0 | — |
| IdeZ2 | | | 566 | 1339 | 0 | 0 | — |
| PRT-241 | 107 | 6 | 406 | 731 | 0 | 0 | 53 |
| PRT-249 | 327 | 17 | 457 | 818 | 0 | 0 | 55 |
| PRT-257 | 547 | 29 | 439 | 1048 | 0 | 0 | 53 |
| PRT-265 | 0 | 0 | 3 | 0 | 0 | 1638 | — |
| PRT-273 | 360 | 19 | 429 | 782 | 0 | 0 | — |
| PRT-281 | 26 | 1 | 317 | 673 | 29 | 347 | — |
| PRT-289 | 937 | 50 | 304 | 581 | 114 | 90 | 57 |
| PRT-297 | 1491 | 80 | 345 | 484 | 0 | 338 | 50 |
| PRT-305 | 760 | 41 | 359 | 786 | 0 | 91 | 53 |
| PRT-313 | 1422 | 76 | 303 | 409 | 328 | 114 | 50 |
| PRT-321 | 701 | 37 | 337 | 469 | 214 | 139 | 55 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-329 | 236 | 13 | 406 | 928 | 0 | 0 | 53 |
| PRT-242 | 228 | 12 | 418 | 1031 | 0 | 0 | 54 |
| PRT-250 | 463 | 25 | 310 | 313 | 454 | 86 | 54 |
| PRT-258 | 708 | 38 | 425 | 762 | 0 | 0 | 39 |
| PRT-266 | 106 | 6 | 401 | 698 | 0 | 0 | 60 |
| PRT-274 | 0 | 0 | 425 | 1036 | 0 | 0 | 54 |
| PRT-282 | 23 | 1 | 150 | 69 | 413 | 34 | 53 |
| PRT-290 | 128 | 7 | 151 | 191 | 0 | 179 | 53 |
| PRT-298 | 198 | 11 | 240 | 494 | 35 | 147 | 57 |
| PRT-306 | 1689 | 90 | 336 | 467 | 0 | 341 | 51 |
| PRT-314 | 1748 | 93 | 286 | 599 | 174 | 101 | 49 |
| PRT-322 | 671 | 36 | 381 | 506 | 0 | 387 | 55 |
| PRT-330 | 333 | 18 | 369 | 493 | 0 | 352 | 52 |
| PRT-243 | 267 | 14 | 430 | 967 | 0 | 25 | 52 |
| PRT-251 | 1326 | 71 | 444 | 1073 | 0 | 0 | — |
| PRT-259 | 671 | 36 | 453 | 1098 | 0 | 0 | 49 |
| PRT-267 | 144 | 8 | 438 | 1090 | 0 | 0 | 59 |
| PRT-275 | 50 | 27 | 257 | 169 | 589 | 97 | 53 |
| PRT-283 | 24 | 1 | 271 | 380 | 91 | 186 | 52 |
| PRT-291 | 702 | 37 | 420 | 1023 | 0 | 0 | 53 |
| PRT-299 | 333 | 18 | 378 | 549 | 0 | 368 | 56 |
| PRT-307 | 517 | 28 | 290 | 215 | 614 | 138 | 53 |
| PRT-315 | 995 | 53 | 408 | 981 | 0 | 0 | 50 |
| PRT-323 | 765 | 41 | 256 | 130 | 743 | 235 | 55 |
| PRT-331 | 283 | 15 | 398 | 954 | 0 | 0 | 52 |
| PRT-244 | 337 | 18 | 429 | 998 | 0 | 0 | 48 |
| PRT-252 | 1360 | 73 | 365 | 634 | 0 | 56 | 43 |
| PRT-260 | 684 | 36 | 354 | 793 | 0 | 0 | 48 |
| PRT-268 | 224 | 12 | 325 | 429 | 282 | 90 | 58 |
| PRT-276 | 451 | 24 | 383 | 912 | 0 | 0 | 43 |
| PRT-284 | 26 | 1 | 184 | 72 | 483 | 45 | 46 |
| PRT-292 | 0 | 0 | 359 | 758 | 0 | 0 | — |
| PRT-300 | 348 | 19 | 274 | 333 | 43 | 276 | 55 |
| PRT-308 | 651 | 35 | 204 | 405 | 106 | 59 | 52 |
| PRT-316 | 292 | 16 | 347 | 772 | 0 | 80 | 56 |
| PRT-324 | 809 | 43 | 291 | 665 | 0 | 0 | 56 |
| PRT-332 | 343 | 18 | 277 | 409 | 177 | 0 | 50 |
| PRT-293 | 0 | 0 | 0 | 11 | 0 | 1260 | — |
| PRT-301 | 0 | 0 | 0 | 0 | 0 | 1676 | — |
| PRT-309 | 0 | 0 | 0 | 0 | 0 | 1646 | — |
| PRT-317 | 552 | 29 | 453 | 798 | 0 | 0 | 54 |
| PRT-325 | 432 | 23 | 466 | 930 | 0 | 78 | 54 |
| PRT-333 | 252 | 13 | 448 | 794 | 0 | 0 | 54 |
| PRT-294 | 2127 | 113 | 456 | 651 | 5 | 506 | 47 |
| PRT-302 | 1046 | 56 | 461 | 1126 | 0 | 0 | 51 |
| PRT-310 | 790 | 42 | 488 | 1224 | 0 | 0 | 48 |
| PRT-318 | 201 | 11 | 365 | 641 | 100 | 110 | 60 |
| PRT-326 | 903 | 48 | 429 | 588 | 0 | 458 | 54 |
| PRT-295 | 875 | 47 | 398 | 529 | 0 | 446 | 52 |
| PRT-303 | 24 | 1 | 482 | 1083 | 0 | 0 | — |
| PRT-311 | 38 | 2 | 295 | 261 | 496 | 109 | — |
| PRT-319 | 509 | 27 | 372 | 670 | 0 | 32 | 55 |
| PRT-327 | 535 | 29 | 338 | 460 | 0 | 472 | 55 |
| PRT-296 | 0 | 0 | 443 | 955 | 0 | 0 | — |
| PRT-304 | 0 | 0 | 320 | 711 | 0 | 0 | — |
| PRT-312 | 17 | 1 | 330 | 703 | 54 | 53 | — |
| PRT-320 | 664 | 35 | 339 | 778 | 0 | 53 | 55 |
| PRT-328 | 236 | 13 | 455 | 1004 | 0 | 75 | 54 |
| PRT-334 | 129 | 7 | 257 | 59 | 738 | 154 | — |
| PRT-342 | 0 | 0 | 209 | 15 | 841 | 206 | — |
| PRT-350 | 130 | 7 | 243 | 520 | 200 | 668 | — |
| PRT-358 | 0 | 0 | 90 | 8 | 375 | 86 | — |
| PRT-366 | 0 | 0 | 122 | 0 | 472 | 777 | — |
| PRT-335 | 129 | 7 | 154 | 38 | 514 | 74 | — |
| PRT-343 | 130 | 7 | 266 | 154 | 682 | 129 | — |
| PRT-351 | 129 | 7 | 191 | 37 | 638 | 86 | — |
| PRT-359 | 144 | 8 | 340 | 260 | 677 | 202 | — |
| PRT-367 | 134 | 7 | 361 | 351 | 518 | 100 | — |
| PRT-336 | 129 | 7 | 264 | 50 | 965 | 370 | — |
| PRT-344 | 169 | 9 | 335 | 562 | 218 | 0 | 53 |
| PRT-352 | 131 | 7 | 302 | 229 | 599 | 281 | — |
| PRT-360 | 130 | 7 | 241 | 89 | 684 | 191 | — |
| PRT-368 | 130 | 7 | 3 | 0 | 0 | 0 | — |
| PRT-337 | 0 | 0 | 74 | 0 | 259 | 38 | — |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-345 | 129 | 7 | 248 | 61 | 772 | 123 | — |
| PRT-353 | 129 | 7 | 259 | 101 | 767 | 189 | — |
| PRT-361 | 129 | 7 | 243 | 86 | 753 | 130 | — |
| PRT-369 | 131 | 7 | 284 | 259 | 445 | 123 | — |
| PRT-338 | 442 | 24 | 203 | 766 | 287 | 0 | 53 |
| PRT-346 | 518 | 28 | 217 | 607 | 246 | 0 | 53 |
| PRT-354 | 525 | 28 | 213 | 618 | 233 | 0 | 53 |
| PRT-362 | 534 | 28 | 225 | 720 | 299 | 0 | 53 |
| PRT-370 | 615 | 33 | 348 | 654 | 288 | 0 | 53 |
| PRT-339 | 271 | 14 | 167 | 721 | 288 | 0 | 53 |
| PRT-347 | 443 | 24 | 397 | 769 | 309 | 0 | 53 |
| PRT-355 | 445 | 24 | 500 | 952 | 367 | 0 | 53 |
| PRT-363 | 366 | 20 | 462 | 838 | 354 | 0 | 53 |
| PRT-371 | 553 | 29 | 373 | 623 | 295 | 0 | 53 |
| PRT-340 | 456 | 24 | 374 | 692 | 307 | 0 | 53 |
| PRT-348 | 548 | 29 | 415 | 736 | 325 | 0 | 53 |
| PRT-356 | 441 | 24 | 418 | 780 | 289 | 0 | 53 |
| PRT-364 | 540 | 29 | 439 | 863 | 334 | 0 | 53 |
| PRT-374 | 589 | 31 | 536 | 985 | 379 | 0 | 53 |
| PRT-341 | 424 | 23 | 199 | 832 | 318 | 0 | 53 |
| PRT-349 | 487 | 26 | 215 | 677 | 286 | 0 | 53 |
| PRT-357 | 459 | 24 | 389 | 724 | 313 | 0 | 53 |
| PRT-365 | 482 | 26 | 385 | 735 | 312 | 0 | 53 |
| PRT-375 | 513 | 27 | 115 | 170 | 180 | 0 | 53 |
| PRT-553 | 45 | 2 | 229 | 79 | 764 | 111 | 56 |
| PRT-526 | 207 | 11 | 379 | 246 | 627 | 110 | 57 |
| PRT-586 | 56 | 3 | 322 | 478 | 458 | 77 | 56 |
| PRT-595 | 121 | 6 | 452 | 1043 | 0 | 0 | 54 |
| PRT-566 | 66 | 4 | 366 | 621 | 0 | 0 | 55 |
| PRT-582 | 51 | 3 | 183 | 28 | 754 | 329 | 56 |
| PRT-576 | 63 | 3 | 365 | 903 | 0 | 0 | 54 |
| PRT-533 | 0 | 0 | 0 | 0 | 0 | 1139 | — |
| PRT-245 | 447 | 24 | 277 | 423 | 204 | 46 | 40 |
| PRT-253 | 602 | 32 | 334 | 912 | 0 | 0 | 50 |
| PRT-261 | 88 | 5 | 76 | 0 | 317 | 615 | 48 |
| PRT-269 | 44 | 2 | 189 | 98 | 592 | 86 | — |
| PRT-559 | 1252 | 67 | 158 | 657 | 0 | 0 | 54 |
| PRT-545 | 1034 | 55 | 435 | 690 | 0 | 0 | 54 |
| PRT-587 | 738 | 39 | 156 | 347 | 120 | 0 | 54 |
| PRT-596 | 353 | 19 | 348 | 753 | 263 | 0 | 54 |
| PRT-571 | 254 | 14 | 383 | 786 | 295 | 0 | 53 |
| PRT-583 | 968 | 52 | 396 | 748 | 261 | 0 | 52 |
| PRT-544 | 0 | 0 | 170 | 12 | 748 | 314 | — |
| PRT-534 | 0 | 0 | 0 | 0 | 0 | 1377 | — |
| PRT-246 | 656 | 35 | 348 | 666 | 221 | 0 | 50 |
| PRT-254 | 1347 | 72 | 359 | 677 | 0 | 0 | 43 |
| PRT-262 | 541 | 29 | 191 | 50 | 802 | 289 | 35 |
| PRT-270 | 439 | 23 | 288 | 376 | 311 | 100 | 48 |
| PRT-554 | 62 | 3 | 350 | 580 | 0 | 36 | 55 |
| PRT-555 | 258 | 14 | 475 | 670 | 0 | 0 | 54 |
| PRT-575 | 54 | 3 | 309 | 254 | 607 | 94 | 58 |
| PRT-567 | 50 | 3 | 297 | 385 | 372 | 65 | 55 |
| PRT-573 | 274 | 15 | 409 | 759 | 0 | 0 | 54 |
| PRT-556 | 411 | 22 | 351 | 570 | 200 | 16 | 53 |
| PRT-541 | 0 | 0 | 0 | 0 | 3 | 854 | — |
| PRT-538 | 0 | 0 | 0 | 5 | 0 | 1160 | — |
| PRT-247 | 0 | 0 | 81 | 0 | 279 | 308 | — |
| PRT-255 | 55 | 3 | 178 | 58 | 525 | 75 | 46 |
| PRT-263 | 71 | 4 | 27 | 0 | 0 | 986 | 37 |
| PRT-271 | 352 | 19 | 322 | 563 | 0 | 0 | 56 |
| PRT-580 | 1250 | 67 | 282 | 566 | 0 | 0 | 55 |
| PRT-528 | 639 | 34 | 114 | 14 | 691 | 354 | 55 |
| PRT-574 | 979 | 52 | 357 | 660 | 227 | 0 | 54 |
| PRT-599 | 423 | 23 | 310 | 930 | 0 | 0 | 54 |
| PRT-561 | 520 | 28 | 405 | 606 | 0 | 0 | 51 |
| PRT-581 | 786 | 42 | 365 | 660 | 0 | 0 | 53 |
| PRT-542 | 0 | 0 | 0 | 0 | 0 | 1471 | — |
| PRT-588 | 690 | 37 | 361 | 658 | 0 | 0 | 63 |
| PRT-248 | 363 | 19 | 370 | 654 | 0 | 0 | 55 |
| PRT-256 | 928 | 49 | 376 | 610 | 0 | 55 | 42 |
| PRT-264 | 675 | 36 | 353 | 606 | 0 | 97 | 45 |
| PRT-272 | 739 | 39 | 389 | 721 | 0 | 0 | 46 |
| PRT-527 | 460 | 25 | 142 | 0 | 396 | 707 | 55 |
| PRT-547 | 124 | 7 | 359 | 527 | 256 | 0 | 54 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-584 | 101 | 5 | 369 | 552 | 285 | 51 | 55 |
| PRT-600 | 726 | 39 | 441 | 992 | 0 | 0 | 53 |
| PRT-590 | 437 | 23 | 217 | 954 | 0 | 0 | 54 |
| PRT-578 | 272 | 15 | 394 | 698 | 0 | 0 | 54 |
| PRT-543 | 0 | 0 | 0 | 0 | 0 | 1473 | — |
| PRT-589 | 269 | 14 | 352 | 863 | 0 | 0 | 56 |
| PRT-277 | 587 | 31 | 160 | 19 | 705 | 401 | 43 |
| PRT-285 | 0 | 0 | 0 | 0 | 0 | 1320 | — |
| PRT-529 | 153 | 8 | 177 | 0 | 350 | 508 | 55 |
| PRT-552 | 61 | 3 | 294 | 439 | 264 | 45 | 55 |
| PRT-558 | 159 | 8 | 281 | 700 | 0 | 0 | 54 |
| PRT-597 | 356 | 19 | 315 | 603 | 0 | 0 | 53 |
| PRT-601 | 456 | 24 | 529 | 720 | 0 | 0 | 50 |
| PRT-579 | 482 | 26 | 450 | 816 | 0 | 0 | 54 |
| PRT-539 | 0 | 0 | 0 | 0 | 0 | 1404 | — |
| PRT-278 | 483 | 26 | 315 | 547 | 0 | 0 | 52 |
| PRT-286 | 302 | 16 | 352 | 650 | 0 | 0 | 46 |
| PRT-546 | 1372 | 73 | 390 | 722 | 236 | 0 | 53 |
| PRT-530 | 836 | 45 | 225 | 87 | 687 | 74 | 54 |
| PRT-551 | 197 | 11 | 217 | 444 | 0 | 0 | 54 |
| PRT-592 | 289 | 15 | 359 | 664 | 0 | 0 | 53 |
| PRT-536 | 0 | 0 | 0 | 0 | 0 | 1527 | — |
| PRT-562 | 938 | 50 | 380 | 705 | 238 | 0 | 55 |
| PRT-540 | 0 | 0 | 0 | 0 | 0 | 1494 | — |
| PRT-279 | 306 | 16 | 359 | 574 | 0 | 48 | 40 |
| PRT-287 | 476 | 25 | 392 | 700 | 0 | 0 | 46 |
| PRT-548 | 1182 | 63 | 458 | 727 | 0 | 0 | 53 |
| PRT-560 | 56 | 3 | 233 | 210 | 312 | 41 | 57 |
| PRT-593 | 430 | 23 | 396 | 797 | 0 | 0 | 52 |
| PRT-591 | 0 | 0 | 34 | 0 | 0 | 671 | — |
| PRT-535 | 0 | 0 | 0 | 6 | 0 | 1528 | — |
| PRT-569 | 1080 | 58 | 294 | 723 | 0 | 0 | 55 |
| PRT-537 | 0 | 0 | 0 | 0 | 0 | 1004 | — |
| PRT-280 | 396 | 21 | 305 | 423 | 0 | 319 | 53 |
| PRT-288 | 411 | 22 | 334 | 439 | 0 | 348 | 45 |
| PRT-376 | 1451 | 77 | 325 | 496 | 196 | 0 | 53 |
| PRT-385 | 1067 | 57 | 265 | 494 | 56 | 103 | 57 |
| PRT-393 | 1736 | 93 | 317 | 663 | 0 | 0 | 55 |
| PRT-401 | 440 | 23 | 329 | 624 | 0 | 128 | 54 |
| PRT-409 | 216 | 12 | 313 | 658 | 0 | 0 | 51 |
| PRT-417 | 1681 | 90 | 27 | 193 | 0 | 324 | 57 |
| PRT-425 | 1669 | 89 | 27 | 568 | 0 | 169 | 60 |
| PRT-443 | 1056 | 56 | 0 | 17 | 535 | 431 | 55 |
| PRT-378 | 1006 | 54 | 319 | 477 | 207 | 0 | 55 |
| PRT-386 | 1476 | 79 | 337 | 519 | 240 | 0 | 49 |
| PRT-394 | 318 | 17 | 323 | 482 | 209 | 0 | 55 |
| PRT-402 | 196 | 10 | 342 | 530 | 188 | 0 | 53 |
| PRT-410 | 1129 | 60 | 297 | 567 | 0 | 206 | 53 |
| PRT-418 | 1288 | 69 | 283 | 382 | 149 | 288 | 55 |
| PRT-426 | 1110 | 59 | 283 | 508 | 0 | 243 | 58 |
| PRT-444 | 354 | 19 | 321 | 494 | 286 | 0 | 53 |
| PRT-379 | 373 | 20 | 370 | 599 | 226 | 0 | 54 |
| PRT-387 | 1265 | 67 | 366 | 605 | 242 | 0 | 54 |
| PRT-395 | 1177 | 63 | 358 | 544 | 204 | 0 | 54 |
| PRT-403 | 453 | 24 | 332 | 569 | 40 | 166 | 53 |
| PRT-411 | 1343 | 72 | 341 | 519 | 155 | 90 | 53 |
| PRT-419 | 618 | 33 | 298 | 528 | 0 | 183 | 59 |
| PRT-427 | 598 | 32 | 352 | 537 | 139 | 135 | 57 |
| PRT-380 | 95 | 5 | 258 | 66 | 702 | 219 | 56 |
| PRT-388 | 1280 | 68 | 338 | 481 | 222 | 34 | 52 |
| PRT-396 | 1256 | 67 | 92 | 0 | 215 | 1007 | 58 |
| PRT-404 | 259 | 14 | 0 | 0 | 0 | 1583 | — |
| PRT-412 | 410 | 22 | 103 | 518 | 170 | 0 | 53 |
| PRT-420 | 521 | 28 | 300 | 515 | 0 | 125 | 60 |
| PRT-428 | 1383 | 74 | 336 | 505 | 119 | 90 | 59 |
| PRT-381 | 1200 | 64 | 334 | 486 | 194 | 0 | 55 |
| PRT-389 | 955 | 51 | 340 | 479 | 219 | 32 | 54 |
| PRT-397 | 1237 | 66 | 243 | 102 | 498 | 93 | 56 |
| PRT-405 | 550 | 29 | 218 | 86 | 558 | 406 | 49 |
| PRT-413 | 1245 | 66 | 347 | 485 | 152 | 14 | 59 |
| PRT-421 | 111502 | 5947 | 340 | 612 | 0 | 71 | 60 |
| PRT-429 | 124592 | 6645 | 348 | 528 | 171 | 57 | 58 |
| PRT-382 | 21379 | 1140 | 380 | 585 | 226 | 0 | 52 |
| PRT-390 | 28472 | 1518 | 371 | 578 | 227 | 0 | 55 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-398 | 314 | 17 | 370 | 555 | 196 | 0 | 49 |
| PRT-406 | 1062 | 57 | 299 | 435 | 108 | 135 | 50 |
| PRT-414 | 1054 | 56 | 341 | 496 | 129 | 77 | 59 |
| PRT-422 | 923 | 49 | 348 | 494 | 136 | 69 | 60 |
| PRT-437 | 949 | 51 | 306 | 445 | 263 | 0 | 55 |
| PRT-383 | 249 | 13 | 379 | 581 | 230 | 0 | 54 |
| PRT-391 | 793 | 42 | 361 | 498 | 192 | 29 | 52 |
| PRT-399 | 8134 | 434 | 0 | 0 | 0 | 1578 | 52 |
| PRT-407 | 4826 | 257 | 277 | 209 | 396 | 90 | — |
| PRT-415 | 2547 | 136 | 225 | 46 | 630 | 164 | 63 |
| PRT-423 | 3064 | 163 | 0 | 398 | 0 | 1659 | 57 |
| PRT-439 | 1011 | 54 | 191 | 179 | 528 | 325 | 54 |
| PRT-384 | 968 | 52 | 0 | 365 | 0 | 1508 | 56 |
| PRT-392 | 1049 | 56 | 354 | 513 | 196 | 0 | 53 |
| PRT-400 | 1050 | 56 | 333 | 556 | 0 | 176 | 52 |
| PRT-408 | 892 | 48 | 334 | 564 | 0 | 179 | 52 |
| PRT-416 | 464 | 25 | 258 | 125 | 453 | 96 | 60 |
| PRT-424 | 982 | 52 | 348 | 618 | 0 | 88 | 59 |
| PRT-442 | 936 | 50 | 169 | 18 | 381 | 680 | 54 |
| PRT-390 | 1146 | 61 | 371 | 578 | 227 | 0 | 55 |
| PRT-398 | 249 | 13 | 370 | 555 | 196 | 0 | 49 |
| PRT-406 | 656 | 35 | 299 | 435 | 108 | 135 | 50 |
| PRT-414 | 1396 | 74 | 341 | 496 | 129 | 77 | 59 |
| PRT-422 | 1289 | 69 | 348 | 494 | 136 | 69 | 60 |
| PRT-437 | 890 | 47 | 306 | 445 | 263 | 0 | 55 |
| PRT-433 | 216 | 12 | 489 | 575 | 224 | 0 | 52 |
| PRT-598 | 833 | 44 | 172 | 567 | 213 | 0 | 53 |
| PRT-383 | 82730 | 4412 | 379 | 581 | 230 | 0 | 54 |
| PRT-391 | 38439 | 2050 | 361 | 498 | 192 | 29 | 52 |
| PRT-399 | 13125 | 700 | 0 | 0 | 0 | 1578 | 52 |
| PRT-407 | 15320 | 817 | 277 | 209 | 396 | 90 | — |
| PRT-415 | 59643 | 3181 | 225 | 46 | 630 | 164 | 63 |
| PRT-423 | 43183 | 2303 | 0 | 398 | 0 | 1659 | 57 |
| PRT-439 | 1004 | 54 | 191 | 179 | 528 | 325 | 54 |
| PRT-434 | 330 | 18 | 314 | 567 | 234 | 0 | — |
| PRT-602 | 882 | 47 | 375 | 543 | 212 | 0 | 56 |
| PRT-384 | 132579 | 7071 | 0 | 365 | 0 | 1508 | 56 |
| PRT-392 | 2165 | 115 | 354 | 513 | 196 | 0 | 53 |
| PRT-400 | 721 | 38 | 333 | 556 | 0 | 176 | 52 |
| PRT-408 | 342 | 18 | 334 | 564 | 0 | 179 | 52 |
| PRT-416 | 2873 | 153 | 258 | 125 | 453 | 96 | 60 |
| PRT-424 | 2690 | 143 | 348 | 618 | 0 | 88 | 59 |
| PRT-442 | 2183 | 116 | 169 | 18 | 381 | 680 | 54 |
| PRT-435 | 2680 | 143 | 205 | 35 | 380 | 625 | 53 |
| PRT-372 | 7 | 0 | 218 | 0 | 560 | 122 | — |
| PRT-456 | 208 | 11 | 497 | 1172 | 0 | 0 | 59 |
| PRT-446 | 744 | 40 | 427 | 1131 | 0 | 0 | 58 |
| PRT-480 | 532 | 28 | 325 | 846 | 0 | 0 | 57 |
| PRT-491 | 101 | 5 | 260 | 769 | 331 | 140 | 56 |
| PRT-468 | 328 | 17 | 385 | 957 | 66 | 115 | 58 |
| PRT-458 | 111 | 6 | 224 | 598 | 226 | 112 | 59 |
| PRT-512 | 877 | 47 | 372 | 884 | 0 | 31 | 55 |
| PRT-506 | 678 | 36 | 453 | 1115 | 0 | 43 | 54 |
| PRT-502 | 1345 | 72 | 283 | 307 | 296 | 66 | 51 |
| PRT-494 | 563 | 30 | 489 | 1212 | 0 | 0 | 56 |
| PRT-618 | 748 | 40 | 419 | 976 | 0 | 0 | 48 |
| PRT-670 | 559 | 30 | 174 | 0 | 798 | 594 | 61 |
| PRT-454 | 9083 | 484 | 317 | 217 | 653 | 94 | 53 |
| PRT-448 | 9626 | 513 | 0 | 0 | 0 | 2150 | 63 |
| PRT-478 | 16264 | 867 | 453 | 509 | 362 | 216 | 51 |
| PRT-476 | 1763 | 94 | 0 | 0 | 0 | 2094 | 58 |
| PRT-466 | 337 | 18 | 362 | 404 | 303 | 161 | 50 |
| PRT-460 | 138 | 7 | 108 | 49 | 64 | 26 | 61 |
| PRT-513 | 720 | 38 | 367 | 397 | 0 | 374 | 54 |
| PRT-508 | 750 | 40 | 0 | 0 | 0 | 0 | 57 |
| PRT-503 | 0 | 0 | 0 | 0 | 0 | 0 | — |
| PRT-496 | 1310 | 70 | 192 | 190 | 0 | 0 | 59 |
| PRT-677 | 596 | 32 | 0 | 0 | 0 | 0 | 56 |
| PRT-682 | 603 | 32 | 0 | 0 | 0 | 0 | 54 |
| PRT-455 | 773 | 41 | 416 | 872 | 333 | 0 | 57 |
| PRT-482 | 1111 | 59 | 322 | 261 | 738 | 146 | 55 |
| PRT-479 | 1344 | 72 | 481 | 1343 | 0 | 0 | 54 |
| PRT-477 | 1211 | 65 | 277 | 543 | 224 | 0 | 57 |
| PRT-467 | 234 | 13 | 374 | 685 | 375 | 57 | 53 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-486 | 128 | 7 | 210 | 145 | 627 | 107 | 55 |
| PRT-525 | 876 | 47 | 386 | 1337 | 0 | 0 | 44 |
| PRT-522 | 976 | 52 | 253 | 736 | 0 | 0 | 45 |
| PRT-504 | 573 | 31 | 442 | 1306 | 0 | 0 | — |
| PRT-518 | 806 | 43 | 423 | 1219 | 0 | 0 | 51 |
| PRT-693 | 934 | 50 | 436 | 1276 | 0 | 0 | 56 |
| PRT-685 | 646 | 34 | 448 | 1201 | 0 | 0 | — |
| PRT-452 | 0 | 0 | 0 | 0 | 0 | 1873 | — |
| PRT-483 | 1036 | 55 | 459 | 1260 | 0 | 0 | 59 |
| PRT-471 | 1170 | 62 | 357 | 1112 | 0 | 0 | — |
| PRT-493 | 795 | 42 | 412 | 1173 | 0 | 0 | 54 |
| PRT-464 | 275 | 15 | 58 | 0 | 0 | 0 | 58 |
| PRT-487 | 181 | 10 | 22 | 0 | 0 | 0 | 58 |
| PRT-514 | 1323 | 71 | 37 | 64 | 0 | 0 | 52 |
| PRT-523 | 1286 | 69 | 24 | 17 | 0 | 0 | 48 |
| PRT-500 | 1404 | 75 | 30 | 25 | 0 | 0 | 56 |
| PRT-519 | 599 | 32 | 17 | 0 | 0 | 0 | 53 |
| PRT-614 | 1592 | 85 | 0 | 0 | 0 | 0 | 43 |
| PRT-662 | 2254 | 120 | 13 | 8 | 0 | 0 | 51 |
| PRT-453 | 569 | 30 | 607 | 1618 | 0 | 17 | 59 |
| PRT-451 | 1278 | 68 | 324 | 1248 | 0 | 0 | 59 |
| PRT-481 | 877 | 47 | 429 | 1385 | 0 | 65 | 56 |
| PRT-474 | 1051 | 56 | 156 | 462 | 229 | 0 | 59 |
| PRT-465 | 162 | 9 | 296 | 504 | 501 | 111 | 59 |
| PRT-463 | 1372 | 73 | 259 | 821 | 0 | 0 | 58 |
| PRT-517 | 0 | 0 | 0 | 0 | 22 | ? | — |
| PRT-511 | 982 | 52 | 312 | 935 | 0 | 62 | 55 |
| PRT-501 | 0 | 0 | 0 | 0 | 0 | 1953 | — |
| PRT-498 | 1264 | 67 | 318 | 488 | 124 | 325 | 56 |
| PRT-688 | 1738 | 93 | 0 | 0 | 0 | 1947 | 59 |
| PRT-667 | 1685 | 90 | 197 | 61 | 896 | 279 | 55 |
| PRT-485 | 457753 | 24414 | 0 | 0 | 0 | 1397 | 58 |
| PRT-450 | 762961 | 40691 | 282 | 300 | 481 | 227 | 61 |
| PRT-470 | 673512 | 35921 | 363 | 1081 | 0 | 0 | 57 |
| PRT-492 | 794154 | 42355 | 207 | 54 | 1020 | 362 | 56 |
| PRT-489 | 133077 | 7097 | 0 | 0 | 0 | 0 | — |
| PRT-462 | 687566 | 36670 | 0 | 0 | 0 | 0 | 59 |
| PRT-515 | 978 | 52 | 0 | 0 | 0 | 0 | 56 |
| PRT-510 | 929 | 50 | 29 | 51 | 0 | 0 | 57 |
| PRT-521 | 1202 | 64 | 13 | 0 | 0 | 0 | 51 |
| PRT-520 | 1114 | 59 | 265 | 271 | 475 | 470 | 53 |
| PRT-636 | 1441 | 77 | 17 | 12 | 0 | 0 | 53 |
| PRT-447 | 469 | 25 | 255 | 376 | 0 | 445 | 57 |
| PRT-484 | 1148 | 61 | 277 | 143 | 973 | 173 | 57 |
| PRT-472 | 1076 | 57 | 386 | 1129 | 0 | 0 | 60 |
| PRT-473 | 1222 | 65 | 384 | 1342 | 0 | 59 | 57 |
| PRT-459 | 216 | 12 | 193 | 137 | 415 | 373 | 56 |
| PRT-488 | 1145 | 61 | 246 | 134 | 803 | 216 | 56 |
| PRT-507 | 741 | 40 | 355 | 927 | 0 | 112 | 54 |
| PRT-524 | 736 | 39 | 285 | 474 | 0 | 676 | 48 |
| PRT-505 | 201 | 11 | 148 | 37 | 752 | 609 | 56 |
| PRT-499 | 557 | 30 | 365 | 637 | 45 | 436 | 57 |
| PRT-689 | 97 | 5 | 248 | 335 | 174 | 376 | 55 |
| PRT-457 | 948 | 51 | 379 | 450 | 337 | 138 | 59 |
| PRT-449 | 1231 | 66 | 365 | 1097 | 0 | 0 | 58 |
| PRT-490 | 1037 | 55 | 243 | 73 | 875 | 166 | 53 |
| PRT-475 | 1418 | 76 | 413 | 1149 | 0 | 0 | 59 |
| PRT-469 | 225 | 12 | 139 | 41 | 248 | 50 | 55 |
| PRT-461 | 1263 | 67 | 309 | 399 | 298 | 154 | 57 |
| PRT-516 | 910 | 49 | 23 | 16 | 0 | 0 | 56 |
| PRT-509 | 512 | 27 | 26 | 21 | 0 | 0 | 54 |
| PRT-495 | 1313 | 70 | 37 | 0 | 0 | 0 | 55 |
| PRT-497 | 749 | 40 | 0 | 0 | 0 | 0 | 55 |
| PRT-635 | 0 | 0 | 0 | 0 | 0 | 0 | — |
| PRT-687 | 496 | 26 | 420 | 738 | 295 | 0 | 53 |
| PRT-624 | 581 | 31 | 251 | 89 | 626 | 96 | — |
| PRT-643 | 850 | 45 | 409 | 664 | 226 | 33 | 46 |
| PRT-646 | 807 | 43 | 435 | 582 | 635 | 39 | 43 |
| PRT-658 | 1206 | 64 | 473 | 822 | 317 | 0 | 53 |
| PRT-609 | 972 | 52 | 216 | 460 | 726 | 702 | 51 |
| PRT-661 | 621 | 33 | 121 | 187 | 70 | 0 | 52 |
| PRT-686 | 1025 | 55 | 355 | 608 | 252 | 0 | 53 |
| PRT-692 | 852 | 45 | 44 | 442 | 38 | 429 | 51 |
| PRT-623 | 864 | 46 | 260 | 433 | 157 | 0 | 52 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-696 | 854 | 46 | 0 | 58. | 19 | 1020 | 51 |
| PRT-549 | 197 | 11 | 491 | 725 | 279 | 0 | 58 |
| PRT-637 | 671 | 36 | 188 | 278 | 602 | 464 | 47 |
| PRT-625 | 839 | 45 | 405 | 451 | 531 | 78 | 52 |
| PRT-644 | 632 | 34 | 518 | 882 | 355 | 0 | 47 |
| PRT-647 | 306 | 16 | 465 | 777 | 330 | 0 | 52 |
| PRT-650 | 711 | 38 | 452 | 522 | 600 | 130 | 51 |
| PRT-683 | 971 | 52 | 570 | 1100 | 0 | 0 | 53 |
| PRT-617 | 253 | 13 | 34 | 630 | 25 | 798 | 42 |
| PRT-675 | 643 | 34 | 400 | 448 | 456 | 229 | 54 |
| PRT-673 | 427 | 23 | 252 | 34 | 989 | 601 | 54 |
| PRT-613 | 667 | 36 | 433 | 686 | 251 | 15 | 39 |
| PRT-695 | 827 | 44 | 433 | 781 | 0 | 66 | 60 |
| PRT-531 | 763 | 41 | 212 | 756 | 0 | 0 | — |
| PRT-631 | 665 | 35 | 419 | 749 | 0 | 0 | 54 |
| PRT-626 | 750 | 40 | 388 | 569 | 225 | 0 | 51 |
| PRT-645 | 1013 | 54 | 455 | 683 | 236 | 0 | 49 |
| PRT-604 | 190 | 10 | 276 | 51 | 964 | 396 | 51 |
| PRT-649 | 787 | 42 | 32 | 657 | 24 | 886 | 48 |
| PRT-638 | 605 | 32 | 10 | 550 | 17 | 823 | 51 |
| PRT-680 | 1051 | 56 | 451 | 752 | 277 | 0 | 55 |
| PRT-676 | 692 | 37 | 136 | 107 | 118 | 0 | 49 |
| PRT-669 | 992 | 53 | 457 | 808 | 0 | 0 | 55 |
| PRT-616 | 1021 | 54 | 495 | 943 | 0 | 0 | 53 |
| PRT-570 | 801 | 43 | 126 | 551 | 0 | 0 | — |
| PRT-557 | 675 | 36 | 410 | 512 | 194 | 0 | 54 |
| PRT-628 | 425 | 23 | 465 | 852 | 0 | 0 | 50 |
| PRT-652 | 142 | 8 | 0 | 410 | 12 | 789 | — |
| PRT-653 | 142 | 8 | 0 | 1353 | 0 | 2353 | — |
| PRT-656 | 359 | 19 | 540 | 841 | 319 | 0 | 49 |
| PRT-648 | 170 | 9 | 206 | 182 | 619 | 417 | 49 |
| PRT-679 | 169 | 9 | 327 | 693 | 54 | 34 | 57 |
| PRT-664 | 432 | 23 | 419 | 703 | 0 | 0 | 57 |
| PRT-674 | 554 | 30 | 0 | 462 | 12 | 891 | 49 |
| PRT-672 | 961 | 51 | 443 | 775 | 0 | 73 | — |
| PRT-678 | 0 | 0 | 0 | 56 | 0 | 39 | — |
| PRT-572 | 755 | 40 | 478 | 936 | 0 | 0 | — |
| PRT-550 | 493 | 26 | 389 | 891 | 0 | 0 | — |
| PRT-627 | 232 | 12 | 415 | 767 | 187 | 124 | 49 |
| PRT-655 | 0 | 0 | 0 | 471 | 15 | 1376 | — |
| PRT-622 | 812 | 43 | 423 | 823 | 0 | 0 | 56 |
| PRT-612 | 648 | 35 | 533 | 986 | 0 | 0 | 51 |
| PRT-606 | 682 | 36 | 406 | 737 | 0 | 0 | 53 |
| PRT-639 | 736 | 39 | 450 | 788 | 0 | 0 | 53 |
| PRT-668 | 157 | 8 | 0 | 563 | 14 | 1069 | 58 |
| PRT-666 | 608 | 32 | 132 | 897 | 0 | 66 | — |
| PRT-607 | 321 | 17 | 470 | 779 | 0 | 0 | 51 |
| PRT-671 | 161 | 9 | 294 | 97 | 864 | 244 | 56 |
| PRT-565 | 158 | 8 | 471 | 783 | 0 | 0 | 54 |
| PRT-532 | 150 | 8 | 118 | 409 | 217 | 506 | 55 |
| PRT-629 | 166 | 9 | 425 | 542 | 461 | 161 | 56 |
| PRT-654 | 142 | 8 | 0 | 401 | 11 | 1173 | — |
| PRT-620 | 703 | 38 | 448 | 792 | 0 | 0 | 56 |
| PRT-659 | 211 | 11 | 499 | 946 | 0 | 0 | 51 |
| PRT-615 | 393 | 21 | 441 | 778 | 0 | 0 | — |
| PRT-640 | 648 | 35 | 507 | 951 | 0 | 0 | 51 |
| PRT-634 | 587 | 31 | 394 | 755 | 0 | 0 | 54 |
| PRT-665 | 524 | 28 | 414 | 816 | 109 | 63 | 54 |
| PRT-632 | 462 | 25 | 399 | 703 | 0 | 0 | — |
| PRT-691 | 143 | 8 | 337 | 184 | 682 | 110 | — |
| PRT-563 | 270 | 14 | 389 | 816 | 0 | 0 | — |
| PRT-630 | 257 | 14 | 464 | 850 | 0 | 0 | 51 |
| PRT-608 | 614 | 33 | 484 | 863 | 0 | 0 | 52 |
| PRT-621 | 561 | 30 | 514 | 976 | 0 | 0 | 55 |
| PRT-657 | 589 | 31 | 250 | 430 | 0 | 0 | 53 |
| PRT-681 | 929 | 50 | 492 | 915 | 0 | 0 | 53 |
| PRT-642 | 678 | 36 | 260 | 175 | 760 | 360 | 50 |
| PRT-633 | 500 | 27 | 429 | 749 | 0 | 0 | 54 |
| PRT-663 | 510 | 27 | 456 | 825 | 0 | 0 | 56 |
| PRT-619 | 147 | 8 | 283 | 140 | 591 | 102 | — |
| PRT-697 | 397 | 21 | 430 | 701 | 161 | 221 | 58 |
| PRT-568 | 532 | 28 | 402 | 880 | 0 | 0 | — |
| PRT-651 | 471 | 25 | 367 | 542 | 359 | 168 | 52 |
| PRT-610 | 743 | 40 | 381 | 688 | 0 | 0 | 51 |

TABLE 15-continued

| Molecule ID | Crude Expression (LabChip) ng/uL | Yield Purified (mg/L) | Enzyme Activity Endpoint Assay (purified) ng/ul (substrate pooled human IgG) | | | | Thermostability Tm1 (° C.) |
|---|---|---|---|---|---|---|---|
| | | | Fc | Fab'2 | scIgG | IgG | |
| PRT-611 | 575 | 31 | 490 | 924 | 0 | 0 | 51 |
| PRT-660 | 148 | 8 | 320 | 161 | 668 | 105 | — |
| PRT-605 | 294 | 16 | 357 | 617 | 157 | 100 | 47 |
| PRT-641 | 654 | 35 | 336 | 975 | 0 | 0 | 52 |
| PRT-684 | 423 | 23 | 542 | 1061 | 0 | 0 | 55 |
| PRT-690 | 378 | 20 | 482 | 966 | 0 | 0 | 50 |
| PRT-603 | 925 | 49 | 486 | 965 | 0 | 0 | 50 |
| PRT-694 | 0 | 0 | 0 | 541 | 15 | 1034 | — |
| PRT-564 | 311 | 17 | 351 | 651 | 0 | 0 | — |
| PRT-373 | 1006 | 54 | 295 | 392 | 281 | 38 | 52 |
| PRT-377 | 1343 | 72 | 348 | 572 | 242 | 0 | 51 |
| PRT-430 | 955 | 51 | 330 | 492 | 324 | 0 | — |
| PRT-431 | 923 | 49 | 310 | 521 | 230 | 0 | 54 |
| PRT-432 | 1050 | 56 | 305 | 462 | 385 | 0 | — |
| PRT-433 | 216 | 12 | 489 | 575 | 224 | 0 | — |
| PRT-434 | 330 | 18 | 314 | 567 | 234 | 0 | — |
| PRT-435 | 2680 | 143 | 205 | 35 | 380 | 625 | 53 |
| PRT-436 | 1476 | 79 | 305 | 445 | 379 | 0 | 53 |
| PRT-438 | 618 | 33 | 320 | 578 | 249 | 0 | — |
| PRT-440 | 1237 | 66 | 328 | 575 | 245 | 0 | — |
| PRT-441 | 949 | 51 | 310 | 514 | 217 | 0 | 56 |
| PRT-445 | 892 | 48 | 330 | 559 | 259 | 0 | 55 |
| PRT-577 | 1245 | 66 | 338 | 566 | 230 | 0 | 54 |
| PRT-585 | 793 | 42 | 303 | 574 | 229 | 0 | 54 |
| PRT-594 | 982 | 52 | 271 | 138 | 487 | 123 | 54 |
| PRT-598 | 833 | 44 | 172 | 567 | 213 | 0 | 53 |
| PRT-602 | 882 | 47 | 375 | 543 | 212 | 0 | 56 |

TABLE 16

| Molecule ID | Crude Expression (LabChip) ng/uL | Enzyme Activity Endpoint Assay (purified) ng/ul (substrate pooled human IgG) | | | |
|---|---|---|---|---|---|
| | | Fc | Fab'2 | scIgG | IgG |
| huIgG_CNTRL | N/A | 0 | 0 | 0 | 1140 |
| VRT-CNTRL1 | 140 | 337 | 178 | 177 | 0 |
| VRT-1 | 35 | 334 | 175 | 137 | 197 |
| VRT-2 | 7 | 238 | 97 | 100 | 247 |
| VRT-3 | 2 | 99 | 0 | 50 | 808 |
| VRT-4 | 0 | 29 | 0 | 24 | 990 |
| VRT-5 | 37 | 294 | 137 | 151 | 89 |
| VRT-6 | 39 | 304 | 132 | 172 | 78 |
| VRT-7 | 15 | 258 | 61 | 249 | 178 |
| VRT-8 | 38 | 126 | 0 | 125 | 652 |
| VRT-10 | 27 | 266 | 56 | 169 | 71 |
| VRT-11 | 0 | 90 | 0 | 38 | 829 |
| VRT-12 | 0 | 101 | 0 | 64 | 747 |
| VRT-13 | 0 | 97 | 0 | 42 | 814 |
| VRT-14 | 36 | 4 | 0 | 22 | 1020 |
| VRT-16 | 0 | 130 | 0 | 91 | 682 |
| VRT-17 | 0 | 5 | 0 | 20 | 1033 |
| VRT-18 | 0 | 4 | 0 | 9 | 995 |
| VRT-19 | 0 | 54 | 0 | 33 | 1254 |
| VRT-20 | 0 | 5 | 0 | 12 | 981 |
| VRT-21 | 0 | 6 | 0 | 11 | 949 |
| VRT-22 | 0 | 31 | 0 | 21 | 1007 |
| VRT-23 | 0 | 29 | 0 | 20 | 1007 |
| VRT-24 | 2 | 187 | 0 | 249 | 392 |
| VRT-25 | 29 | 204 | 12 | 284 | 183 |
| VRT-26 | 3 | 213 | 0 | 342 | 303 |
| VRT-27 | 0 | 92 | 0 | 33 | 1151 |
| VRT-28 | 2 | 3 | 0 | 22 | 987 |
| VRT-30 | 0 | 46 | 0 | 22 | 986 |
| VRT-31 | 0 | 27 | 0 | 21 | 1020 |
| VRT-32 | 0 | 96 | 0 | 79 | 803 |
| VRT-33 | 12 | 5 | 0 | 21 | 1037 |
| VRT-34 | 10 | 5 | 0 | 20 | 1018 |
| VRT-35 | 0 | 25 | 0 | 22 | 1019 |
| VRT-36 | 0 | 112 | 0 | 62 | 1030 |
| VRT-37 | 0 | 101 | 0 | 38 | 854 |
| VRT-38 | 0 | 27 | 0 | 20 | 990 |
| VRT-39 | 0 | 27 | 0 | 22 | 1025 |
| VRT-40 | 75 | 243 | 63 | 222 | 167 |
| VRT-42 | 0 | 28 | 0 | 20 | 985 |
| VRT-43 | 3 | 28 | 0 | 23 | 1007 |
| VRT-44 | 18 | 28 | 0 | 21 | 1066 |
| VRT-47 | 3 | 317 | 168 | 156 | 253 |
| VRT-48 | 10 | 222 | 9 | 258 | 134 |
| VRT-49 | 20 | 291 | 135 | 131 | 157 |
| VRT-50 | 13 | 226 | 8 | 360 | 295 |
| VRT-52 | 0 | 213 | 6 | 311 | 238 |
| VRT-53 | 24 | 209 | 0 | 339 | 326 |
| VRT-54 | 105 | 129 | 0 | 150 | 672 |
| VRT-55 | 25 | 120 | 0 | 109 | 734 |
| VRT-56 | 44 | 200 | 0 | 240 | 742 |
| VRT-57 | 0 | 97 | 0 | 27 | 903 |
| VRT-58 | 67 | 191 | 0 | 236 | 527 |
| VRT-59 | 21 | 157 | 0 | 107 | 726 |
| VRT-202 | 54 | 393 | 140 | 80 | 49 |
| VRT-203 | 0 | 59 | 0 | 26 | 1191 |
| VRT-205 | 0 | 35 | 0 | 25 | 1179 |
| VRT-206 | 71 | 404 | 176 | 129 | 68 |
| VRT-60 | 67 | 487 | 173 | 236 | 101 |
| VRT-61 | 39 | 538 | 129 | 281 | 25 |
| VRT-63 | 0 | 68 | 0 | 11 | 1181 |
| VRT-64 | 28 | 45 | 0 | 0 | 1062 |
| VRT-65 | 35 | 475 | 146 | 180 | 72 |
| VRT-66 | 0 | 69 | 0 | 0 | 1401 |
| VRT-67 | 37 | 472 | 130 | 218 | 77 |
| VRT-68 | 39 | 476 | 159 | 235 | 70 |
| VRT-69 | 38 | 336 | 0 | 400 | 108 |
| VRT-70 | 0 | 45 | 0 | 0 | 1349 |
| VRT-71 | 0 | 50 | 0 | 0 | 1113 |
| VRT-72 | 0 | 335 | 11 | 432 | 111 |

TABLE 16-continued

| Molecule ID | Crude Expression (LabChip) ng/uL | Enzyme Activity Endpoint Assay (purified) ng/ul (substrate pooled human IgG) | | | |
|---|---|---|---|---|---|
| | | Fc | Fab'2 | scIgG | IgG |
| VRT-73 | 0 | 47 | 0 | 0 | 1283 |
| VRT-74 | 0 | 71 | 0 | 25 | 1055 |
| VRT-77 | 0 | 67 | 0 | 0 | 1296 |
| VRT-78 | 0 | 260 | 0 | 325 | 127 |
| VRT-79 | 0 | 153 | 0 | 109 | 748 |
| VRT-80 | 0 | 48 | 0 | 0 | 999 |
| VRT-81 | 0 | 47 | 0 | 26 | 1190 |
| VRT-83 | 0 | 49 | 0 | 0 | 1044 |
| VRT-84 | 0 | 70 | 0 | 0 | 1147 |
| VRT-85 | 0 | 500 | 217 | 152 | 0 |
| VRT-88 | 0 | 466 | 133 | 110 | 70 |
| VRT-89 | 0 | 291 | 0 | 410 | 253 |
| VRT-90 | 29 | 477 | 172 | 117 | 0 |
| VRT-91 | 0 | 326 | 0 | 321 | 270 |
| VRT-93 | 0 | 430 | 76 | 203 | 77 |
| VRT-94 | 0 | 217 | 0 | 253 | 690 |
| VRT-95 | 0 | 47 | 0 | 0 | 1154 |
| VRT-96 | 0 | 45 | 0 | 26 | 1080 |
| VRT-97 | 0 | 378 | 51 | 282 | 99 |
| VRT-98 | 0 | 44 | 0 | 26 | 1119 |
| VRT-99 | 54 | 386 | 151 | 89 | 209 |
| VRT-101 | 49 | 505 | 150 | 0 | 0 |
| VRT-102 | 31 | 441 | 174 | 40 | 190 |
| VRT-103 | 0 | 297 | 0 | 259 | 383 |
| VRT-104 | 0 | 177 | 0 | 138 | 687 |
| VRT-105 | 26 | 434 | 208 | 42 | 0 |
| VRT-107 | 0 | 198 | 0 | 157 | 545 |
| VRT-108 | 42 | 229 | 0 | 254 | 598 |
| VRT-109 | 51 | 337 | 54 | 293 | 0 |
| VRT-113 | 0 | 161 | 0 | 76 | 1100 |
| VRT-114 | 37 | 261 | 13 | 285 | 189 |
| VRT-115 | 41 | 258 | 20 | 356 | 428 |
| VRT-116 | 0 | 275 | 0 | 261 | 451 |
| VRT-117 | 52 | 149 | 0 | 192 | 482 |
| VRT-118 | 29 | 273 | 26 | 273 | 315 |
| VRT-119 | 25 | 178 | 0 | 247 | 491 |
| VRT-120 | 41 | 202 | 12 | 214 | 462 |
| VRT-121 | 38 | 161 | 0 | 196 | 756 |
| VRT-122 | 0 | 186 | 0 | 193 | 645 |
| VRT-123 | 38 | 237 | 16 | 262 | 462 |
| VRT-124 | 34 | 267 | 17 | 367 | 421 |
| VRT-125 | 0 | 320 | 14 | 345 | 438 |
| VRT-126 | 0 | 143 | 0 | 0 | 933 |
| VRT-127 | 0 | 183 | 0 | 56 | 757 |
| VRT-128 | 0 | 136 | 0 | 0 | 1048 |
| VRT-130 | 0 | 21 | 0 | 0 | 1248 |
| VRT-131 | 0 | 117 | 0 | 36 | 768 |
| VRT-132 | 0 | 105 | 0 | 32 | 1209 |
| VRT-133 | 0 | 133 | 0 | 0 | 1119 |
| VRT-134 | 0 | 162 | 0 | 137 | 591 |
| VRT-135 | 94 | 415 | 127 | 65 | 112 |
| VRT-136 | 76 | 381 | 102 | 34 | 119 |
| VRT-137 | 93 | 319 | 27 | 319 | 73 |
| VRT-138 | 63 | 454 | 106 | 148 | 93 |
| VRT-139 | 93 | 402 | 113 | 107 | 105 |
| VRT-140 | 45 | 243 | 0 | 330 | 324 |
| VRT-141 | 93 | 482 | 151 | 64 | 142 |
| VRT-142 | 70 | 329 | 0 | 383 | 283 |
| VRT-143 | 64 | 388 | 114 | 121 | 89 |
| VRT-144 | 51 | 382 | 97 | 163 | 64 |
| VRT-145 | 70 | 393 | 111 | 142 | 84 |
| VRT-146 | 67 | 470 | 174 | 104 | 175 |
| VRT-147 | 57 | 384 | 120 | 57 | 113 |
| VRT-148 | 0 | 282 | 0 | 388 | 238 |
| VRT-149 | 0 | 309 | 29 | 339 | 155 |
| VRT-150 | 0 | 278 | 17 | 271 | 177 |
| VRT-151 | 0 | 148 | 0 | 41 | 849 |
| VRT-152 | 22 | 291 | 40 | 276 | 190 |
| VRT-153 | 0 | 258 | 0 | 274 | 354 |
| VRT-154 | 0 | 223 | 0 | 254 | 391 |
| VRT-155 | 30 | 337 | 35 | 349 | 232 |
| VRT-156 | 38 | 238 | 0 | 332 | 457 |
| VRT-158 | 54 | 248 | 0 | 348 | 282 |
| VRT-159 | 39 | 125 | 0 | 0 | 1142 |
| VRT-161 | 50 | 257 | 0 | 356 | 262 |
| VRT-162 | 35 | 218 | 0 | 344 | 332 |
| VRT-164 | 61 | 356 | 0 | 426 | 85 |
| VRT-165 | 0 | 36 | 0 | 0 | 1318 |
| VRT-166 | 0 | 27 | 0 | 0 | 1229 |
| VRT-169 | 0 | 36 | 0 | 0 | 1420 |
| VRT-170 | 0 | 25 | 0 | 0 | 1248 |
| VRT-62 | 224 | 333 | 124 | 161 | 15 |
| VRT-75 | 0 | 10 | 0 | 14 | 1213 |
| VRT-76 | 93 | 382 | 279 | 161 | 104 |
| VRT-82 | 0 | 0 | 0 | 32 | 1413 |
| VRT-85 | 54 | 401 | 302 | 315 | 109 |
| VRT-92 | 49 | 436 | 330 | 232 | 0 |
| VRT-100 | 144 | 395 | 304 | 370 | 0 |
| VRT-110 | 109 | 260 | 74 | 630 | 282 |
| VRT-111 | 53 | 205 | 71 | 294 | 392 |
| VRT-112 | 96 | 226 | 50 | 545 | 36 |
| VRT-129 | 0 | 209 | 27 | 322 | 311 |
| VRT-157 | 49 | 273 | 60 | 208 | 374 |
| VRT-159 | 101 | 280 | 115 | 402 | 169 |
| VRT-163 | 62 | 253 | 60 | 405 | 75 |
| VRT-167 | 0 | 148 | 0 | 249 | 565 |
| VRT-168 | 0 | 10 | 0 | 366 | 983 |
| VRT-171 | 43 | 143 | 5 | 215 | 713 |
| VRT-172 | 0 | 162 | 488 | 180 | 510 |
| VRT-173 | 0 | 4 | 0 | 12 | 1269 |
| VRT-174 | 0 | 3 | 0 | 48 | 1259 |
| VRT-175 | 47 | 183 | 21 | 404 | 591 |
| VRT-176 | 48 | 155 | 7 | 344 | 826 |
| VRT-177 | 59 | 232 | 19 | 390 | 658 |
| VRT-179 | 48 | 140 | 0 | 637 | 392 |
| VRT-180 | 54 | 131 | 0 | 200 | 816 |
| VRT-181 | 92 | 172 | 24 | 390 | 568 |
| VRT-182 | 67 | 187 | 13 | 276 | 731 |
| VRT-183 | 89 | 53 | 0 | 113 | 1125 |
| VRT-184 | 105 | 0 | 0 | 104 | 1069 |
| VRT-185 | 45 | 102 | 0 | 601 | 862 |
| VRT-186 | 54 | 99 | 0 | 119 | 988 |
| VRT-187 | 66 | 98 | 0 | 610 | 712 |
| VRT-188 | 0 | 5 | 0 | 13 | 1469 |
| VRT-189 | 69 | 62 | 0 | 96 | 1110 |
| VRT-190 | 65 | 86 | 0 | 0 | 1450 |
| VRT-191 | 56 | 43 | 0 | 14 | 1252 |
| VRT-192 | 61 | 90 | 0 | 115 | 1011 |
| VRT-193 | 102 | 9 | 0 | 411 | 968 |
| VRT-194 | 99 | 3 | 0 | 101 | 1309 |
| VRT-196 | 0 | 114 | 0 | 206 | 849 |
| VRT-197 | 0 | 59 | 0 | 9 | 1111 |
| VRT-198 | 93 | 434 | 370 | 147 | 0 |
| VRT-199 | 111 | 443 | 368 | 190 | 0 |
| VRT-200 | 149 | 397 | 321 | 320 | 102 |
| VRT-204 | 0 | 136 | 0 | 151 | 865 |
| VRT-62 | 210 | 390 | 294 | 388 | 0 |
| VRT-75 | 0 | 10 | 0 | 26 | 1255 |
| VRT-76 | 101 | 394 | 269 | 229 | 0 |
| VRT-82 | 0 | 0 | 0 | 12 | 1431 |
| VRT-86 | 65 | 438 | 304 | 459 | 0 |
| VRT-92 | 61 | 347 | 275 | 242 | 0 |
| VRT-100 | 162 | 449 | 368 | 294 | 123 |
| VRT-110 | 163 | 236 | 84 | 464 | 120 |
| VRT-111 | 59 | 238 | 117 | 362 | 287 |
| VRT-112 | 91 | 207 | 36 | 372 | 25 |
| VRT-129 | 0 | 226 | 30 | 372 | 286 |
| VRT-157 | 59 | 275 | 58 | 440 | 144 |
| VRT-159 | 130 | 363 | 196 | 178 | 507 |
| VRT-163 | 95 | 237 | 41 | 354 | 56 |
| VRT-167 | 41 | 194 | 9 | 266 | 490 |
| VRT-168 | 0 | 9 | 0 | 328 | 1454 |
| VRT-171 | 52 | 209 | 37 | 365 | 481 |
| VRT-172 | 0 | 143 | 5 | 172 | 510 |
| VRT-173 | 0 | 41 | 0 | 10 | 1001 |
| VRT-174 | 40 | 0 | 0 | 12 | 1439 |
| VRT-175 | 56 | 251 | 49 | 539 | 439 |
| VRT-176 | 72 | 156 | 0 | 658 | 179 |

TABLE 16-continued

| Molecule ID | Crude Expression (LabChip) ng/uL | Enzyme Activity Endpoint Assay (purified) ng/ul (substrate pooled human IgG) | | | |
|---|---|---|---|---|---|
| | | Fc | Fab'2 | scIgG | IgG |
| VRT-177 | 66 | 235 | 25 | 419 | 510 |
| VRT-179 | 80 | 139 | 0 | 583 | 215 |
| VRT-180 | 74 | 179 | 16 | 359 | 549 |
| VRT-181 | 104 | 177 | 23 | 367 | 571 |
| VRT-182 | 95 | 223 | 26 | 264 | 549 |
| VRT-183 | 99 | 53 | 0 | 111 | 1205 |
| VRT-184 | 112 | 0 | 0 | 13 | 1400 |
| VRT-185 | 72 | 93 | 0 | 450 | 303 |
| VRT-186 | 73 | 125 | 0 | 119 | 784 |
| VRT-187 | 124 | 130 | 0 | 145 | 269 |
| VRT-188 | 0 | 0 | 0 | 29 | 1297 |
| VRT-189 | 96 | 58 | 0 | 19 | 1249 |
| VRT-190 | 96 | 77 | 0 | 107 | 1105 |
| VRT-191 | 124 | 62 | 0 | 48 | 776 |
| VRT-192 | 102 | 103 | 0 | 118 | 758 |
| VRT-193 | 109 | 9 | 0 | 75 | 1242 |
| VRT-194 | 121 | 3 | 0 | 105 | 1420 |
| VRT-196 | 0 | 225 | 112 | 309 | 237 |
| VRT-197 | 0 | 74 | 0 | 535 | 1060 |
| VRT-198 | 115 | 383 | 339 | 192 | 0 |
| VRT-199 | 144 | 357 | 0 | 0 | 0 |
| VRT-200 | 207 | 423 | 369 | 138 | 0 |
| VRT-204 | 0 | 152 | 0 | 174 | 1055 |
| VRT-207 | 0 | 16 | 0 | 0 | 1097 |
| VRT-208 | 0 | 106 | 0 | 0 | 880 |
| VRT-209 | 0 | 17 | 0 | 0 | 1062 |
| VRT-210 | 0 | 25 | 0 | 0 | 1130 |
| VRT-211 | 0 | 116 | 0 | 0 | 912 |
| VRT-212 | 0 | 18 | 0 | 0 | 1216 |
| VRT-213 | 0 | 122 | 0 | 94 | 827 |
| VRT-214 | 0 | 19 | 0 | 0 | 1473 |
| VRT-215 | 0 | 15 | 0 | 0 | 1262 |
| VRT-216 | 0 | 11 | 0 | 0 | 1322 |
| VRT-217 | 0 | 119 | 0 | 57 | 961 |
| VRT-218 | 0 | 27 | 0 | 0 | 1272 |
| VRT-219 | 0 | 39 | 0 | 0 | 2524 |
| VRT-220 | 0 | 20 | 0 | 0 | 1239 |
| VRT-221 | 0 | 20 | 0 | 0 | 1368 |
| VRT-222 | 0 | 18 | 0 | 0 | 1337 |
| VRT-223 | 0 | 0 | 0 | 0 | 1353 |
| VRT-224 | 0 | 13 | 0 | 0 | 1293 |
| VRT-225 | 0 | 18 | 0 | 0 | 1362 |
| VRT-227 | 27 | 106 | 0 | 33 | 1244 |
| VRT-228 | 0 | 23 | 0 | 0 | 1502 |
| VRT-229 | 0 | 16 | 0 | 0 | 1293 |
| VRT-230 | 0 | 11 | 0 | 0 | 1269 |
| VRT-231 | 0 | 88 | 0 | 0 | 1215 |
| VRT-232 | 0 | 12 | 0 | 0 | 1137 |
| VRT-233 | 0 | 11 | 0 | 0 | 1062 |
| VRT-234 | 0 | 115 | 0 | 0 | 1194 |
| VRT-235 | 0 | 19 | 0 | 0 | 1149 |
| VRT-236 | 0 | 246 | 0 | 151 | 1021 |
| VRT-237 | 0 | 182 | 0 | 230 | 438 |
| VRT-238 | 0 | 16 | 0 | 0 | 1158 |
| VRT-239 | 0 | 95 | 0 | 0 | 972 |
| VRT-240 | 0 | 165 | 0 | 190 | 456 |
| VRT-241 | 0 | 13 | 0 | 0 | 1118 |
| VRT-242 | 0 | 144 | 0 | 138 | 605 |
| VRT-243 | 0 | 29 | 0 | 0 | 1091 |
| VRT-244 | 0 | 50 | 0 | 0 | 2156 |
| VRT-245 | 0 | 20 | 0 | 0 | 1090 |
| VRT-246 | 36 | 340 | 164 | 15 | 76 |
| VRT-247 | 31 | 189 | 0 | 74 | 1702 |
| VRT-249 | 30 | 357 | 146 | 120 | 77 |
| VRT-250 | 28 | 84 | 0 | 0 | 1038 |
| VRT-251 | 0 | 11 | 0 | 0 | 1030 |
| VRT-252 | 0 | 296 | 29 | 272 | 0 |
| VRT-253 | 0 | 15 | 0 | 0 | 1479 |
| VRT-254 | 0 | 16 | 0 | 0 | 1228 |
| VRT-255 | 0 | 217 | 0 | 378 | 441 |
| VRT-256 | 0 | 16 | 0 | 0 | 1391 |
| VRT-257 | 0 | 0 | 0 | 0 | 1164 |
| VRT-258 | 0 | 21 | 0 | 340 | 255 |
| VRT-259 | 0 | 19 | 0 | 0 | 1097 |
| VRT-260 | 0 | 19 | 0 | 0 | 1132 |
| VRT-262 | 0 | 19 | 0 | 0 | 1230 |
| VRT-263 | 0 | 14 | 0 | 0 | 1245 |
| VRT-264 | 99 | 140 | 0 | 137 | 768 |
| VRT-265 | 105 | 113 | 0 | 105 | 935 |
| VRT-266 | 112 | 9 | 0 | 51 | 1187 |
| VRT-267 | 95 | 20 | 0 | 64 | 1660 |

Example 13: Polypeptides Having Protease Activity Comprise Mutations that Either Increase or Decrease Pre-Existing Anti-Protease Antibody Recognition of Ig Proteases A competition assay for measuring pre-existing human anti-protease antibodies (MSD competition assay) was used to measure the ability of a mutant (or wild-type) protease in solution to compete for anti-protease antibodies present in IVIG and reduce the binding of those anti-protease antibodies to plate captured wild-type protease. This enabled to assess whether mutations made to a protease ablated its recognition by anti-protease antibodies present in IVIG allowing a greater proportion of the pre-existing antibodies to bind the plate captured wild-type protease.

Briefly, a mouse anti-his tag antibody was coated onto a MSD plate and incubated overnight at 4° C. Parental wild-type protease (for example IdeS) was inactivated with iodocetamide and captured via its His Tag onto the anti-His coated plate surface and washed after 1 hr at room temperature. Diluted human IVIG was mixed and incubated with test article proteases (which may be wild-type or polypeptides having protease activity) for 1 hr at room temperature. The IVIG/test article protease mixture was applied to the plate upon which parental protease was captured and incubated for 1 hr, allowing any pre-existing anti-protease antibodies present in the IVIG, and which are not complexed with test article, to bind the plate captured wild-type protease. After washing, anti-protease antibodies bound to the plate captured wild-type protease were detected using a biotinylated anti-human IgG (H+L) antibody which was applied to the plate for one hour at room temperature. After washing, a streptavidin-sulfotag reagent was applied to the plate. After another washing step the MSD read buffer was added and the plates were read on the MSD model 1300.

Signals from the assay were normalized as =1/[signal for test article/signal for wild-type]. The value of this normalized signal was interpreted as follows:

(1) If normalized signal=1.0 then no change in pre-existing anti-protease antibody recognition of test article relative to wild-type protease;
(2) If normalized signal <1.0 then there is reduced anti-protease antibody recognition of test article relative to wild-type protease;
(3) If normalized signal >1.0 then there is increased anti-protease antibody recognition of test article relative to wild-type protease.

The data shown in Table 17, Table 18, and Table 19 illustrates polypeptides having protease activity comprising mutations that can either increase or decrease pre-existing anti-protease recognition of these Ig proteases.

TABLE 17

| IdeS mutants | | Ide85 mutants | | IdeZ mutants | |
|---|---|---|---|---|---|
| Molecule ID | Normalized assay signal for IdeS mutants plated against IdeS and IdeS used to normalize | Molecule ID | Normalized assay signal for Ide85 mutants plated against IdeS and Ide85 used to normalize | Molecule ID | Normalized assay signal for IdeZ mutants plated against IdeS and IdeZ used to normalize |
| PRT-5 | 0.63 | PRT-71 | 1.12 | PRT-106 | 0.32 |
| PRT-7 | 0.64 | PRT-72 | 1.04 | PRT-107 | 0.33 |
| PRT-6 | 0.70 | PRT-73 | 0.96 | PRT-108 | 0.32 |
| PRT-8 | 0.63 | PRT-75 | 1.17 | PRT-109 | 0.28 |
| PRT-13 | 0.45 | PRT-76 | 0.79 | PRT-110 | 0.28 |
| PRT-15 | 0.43 | PRT-77 | 0.86 | PRT-111 | 0.30 |
| PRT-14 | 0.44 | PRT-78 | 0.82 | PRT-112 | 0.32 |
| PRT-16 | 0.42 | PRT-79 | 0.86 | PRT-113 | 0.33 |
| PRT-17 | 0.53 | PRT-80 | 0.77 | PRT-114 | 0.33 |
| PRT-18 | 0.51 | PRT-82 | 0.63 | PRT-115 | 0.32 |
| PRT-19 | 0.36 | PRT-83 | 0.72 | PRT-116 | 0.34 |
| PRT-20 | 0.55 | PRT-84 | 0.86 | PRT-117 | 0.31 |
| PRT-21 | 0.37 | PRT-85 | 0.60 | PRT-118 | 0.30 |
| PRT-23 | 0.90 | PRT-86 | 0.76 | PRT-119 | 0.31 |
| PRT-22 | 0.93 | PRT-87 | 0.76 | PRT-120 | 0.32 |
| PRT-24 | 0.57 | PRT-88 | 1.19 | PRT-121 | 0.33 |
| PRT-25 | 0.49 | PRT-89 | 1.15 | PRT-122 | 0.34 |
| PRT-26 | 0.55 | PRT-90 | 1.15 | PRT-123 | 0.32 |
| PRT-27 | 0.88 | PRT-91 | 0.80 | PRT-124 | 0.31 |
| PRT-28 | 0.95 | PRT-92 | 0.98 | PRT-125 | 0.28 |
| PRT-29 | 0.77 | PRT-93 | 0.94 | PRT-126 | 0.29 |
| PRT-31 | 1.21 | PRT-94 | 0.90 | PRT-127 | 0.32 |
| PRT-30 | 0.91 | PRT-95 | 0.97 | PRT-128 | 0.30 |
| PRT-32 | 1.01 | PRT-96 | 0.94 | PRT-129 | 0.29 |
| PRT-33 | 0.96 | PRT-97 | 0.97 | PRT-130 | 0.31 |
| PRT-34 | 1.00 | PRT-98 | 1.09 | PRT-131 | 0.29 |
| PRT-35 | 1.05 | PRT-99 | 1.07 | PRT-133 | 0.29 |
| PRT-36 | 1.11 | PRT-100 | 1.10 | PRT-134 | 0.28 |
| PRT-37 | 1.00 | PRT-101 | 1.06 | PRT-135 | 0.29 |
| PRT-39 | 0.98 | PRT-102 | 0.96 | PRT-136 | 0.30 |
| PRT-38 | 1.01 | PRT-103 | 1.07 | PRT-137 | 0.29 |
| PRT-40 | 0.99 | PRT-104 | 1.11 | PRT-138 | 0.28 |
| PRT-41 | 0.73 | PRT-105 | 1.07 | PRT-139 | 0.29 |
| PRT-42 | 0.82 | PRT-2 | 1.02 | PRT-140 | 0.28 |
| PRT-43 | 0.75 | PRT-72 | 1.16 | PRT-141 | 0.31 |
| PRT-44 | 0.63 | PRT-73 | 1.11 | PRT-142 | 0.27 |
| PRT-45 | 0.62 | PRT-80 | 0.82 | | |
| PRT-47 | 0.53 | PRT-81 | 0.73 | | |
| PRT-46 | 0.66 | PRT-83 | 0.81 | | |
| PRT-48 | 0.32 | PRT-84 | 0.72 | | |
| PRT-49 | 0.57 | PRT-87 | 0.68 | | |
| PRT-50 | 0.53 | PRT-88 | 0.94 | | |
| PRT-51 | 0.42 | PRT-89 | 1.02 | | |
| PRT-52 | 0.44 | PRT-90 | 0.98 | | |
| PRT-53 | 0.83 | PRT-91 | 0.92 | | |
| PRT-54 | 0.93 | PRT-92 | 0.93 | | |
| PRT-55 | 0.94 | PRT-2 | 1.00 | | |
| PRT-56 | 0.63 | PRT-187 | 0.85 | | |
| PRT-57 | 0.68 | | | | |
| PRT-58 | 0.80 | | | | |
| PRT-59 | 0.97 | | | | |
| PRT-60 | 1.07 | | | | |
| PRT-61 | 0.91 | | | | |
| PRT-62 | 1.08 | | | | |
| PRT-63 | 0.86 | | | | |
| PRT-64 | 0.98 | | | | |
| PRT-65 | 0.97 | | | | |
| PRT-66 | 1.25 | | | | |
| PRT-67 | 0.96 | | | | |
| PRT-68 | 1.05 | | | | |
| PRT-69 | 0.89 | | | | |
| PRT-70 | 1.16 | | | | |
| PRT-143 | 0.56 | | | | |
| PRT-144 | 0.48 | | | | |
| PRT-145 | 0.47 | | | | |
| PRT-146 | 0.44 | | | | |
| PRT-147 | 0.40 | | | | |
| PRT-148 | 0.83 | | | | |
| PRT-149 | 0.77 | | | | |
| PRT-150 | 0.67 | | | | |

TABLE 17-continued

| | IdeS mutants | | Ide85 mutants | | IdeZ mutants |
| --- | --- | --- | --- | --- | --- |
| Molecule ID | Normalized assay signal for IdeS mutants plated against IdeS and IdeS used to normalize | Molecule ID | Normalized assay signal for Ide85 mutants plated against IdeS and Ide85 used to normalize | Molecule ID | Normalized assay signal for IdeZ mutants plated against IdeS and IdeZ used to normalize |
| PRT-151 | 0.79 | | | | |
| PRT-152 | 0.93 | | | | |
| PRT-153 | 0.73 | | | | |
| PRT-154 | 0.71 | | | | |
| PRT-155 | 0.63 | | | | |
| PRT-156 | 0.87 | | | | |
| PRT-157 | 0.88 | | | | |
| PRT-158 | 0.68 | | | | |
| PRT-159 | 0.81 | | | | |
| PRT-160 | 0.66 | | | | |
| PRT-161 | 0.52 | | | | |
| PRT-162 | 0.73 | | | | |
| PRT-163 | 0.65 | | | | |
| PRT-164 | 0.68 | | | | |
| PRT-165 | 0.61 | | | | |
| PRT-166 | 0.61 | | | | |
| PRT-167 | 0.80 | | | | |
| PRT-168 | 0.84 | | | | |
| PRT-169 | 0.68 | | | | |
| PRT-170 | 0.73 | | | | |
| PRT-171 | 0.66 | | | | |
| PRT-172 | 0.64 | | | | |
| PRT-173 | 0.63 | | | | |
| PRT-174 | 0.57 | | | | |
| PRT-175 | 0.44 | | | | |
| PRT-178 | 0.78 | | | | |
| PRT-179 | 0.84 | | | | |
| PRT-180 | 0.93 | | | | |
| PRT-181 | 0.81 | | | | |
| PRT-182 | 0.82 | | | | |
| PRT-183 | 0.65 | | | | |
| PRT-184 | 0.85 | | | | |
| PRT-186 | 0.57 | | | | |
| PRT-1 | 1.06 | | | | |
| PRT-6 | 0.73 | | | | |
| PRT-7 | 0.63 | | | | |
| PRT-8 | 0.54 | | | | |
| PRT-9 | 0.67 | | | | |
| PRT-11 | 0.51 | | | | |
| PRT-12 | 0.48 | | | | |
| PRT-15 | 0.44 | | | | |
| PRT-17 | 0.54 | | | | |
| PRT-18 | 0.49 | | | | |
| PRT-19 | 0.44 | | | | |
| PRT-20 | 0.47 | | | | |
| PRT-23 | 0.64 | | | | |
| PRT-24 | 0.58 | | | | |
| PRT-25 | 0.50 | | | | |
| PRT-27 | 0.86 | | | | |
| PRT-31 | 0.97 | | | | |
| PRT-32 | 1.03 | | | | |
| PRT-33 | 1.03 | | | | |
| PRT-34 | 0.82 | | | | |
| PRT-35 | 0.92 | | | | |
| PRT-36 | 0.96 | | | | |
| PRT-40 | 0.95 | | | | |
| PRT-41 | 0.72 | | | | |
| PRT-43 | 0.70 | | | | |
| PRT-44 | 0.61 | | | | |
| PRT-49 | 0.69 | | | | |
| PRT-63 | 0.86 | | | | |
| PRT-64 | 1.00 | | | | |
| PRT-65 | 0.98 | | | | |
| PRT-66 | 0.89 | | | | |
| PRT-67 | 0.94 | | | | |
| PRT-1 | 0.93 | | | | |
| PRT-4 | 0.83 | | | | |
| PRT-9 | 0.62 | | | | |
| PRT-10 | 0.51 | | | | |
| PRT-11 | 0.50 | | | | |

TABLE 17-continued

| | IdeS mutants | | Ide85 mutants | | IdeZ mutants |
|---|---|---|---|---|---|
| Molecule ID | Normalized assay signal for IdeS mutants plated against IdeS and IdeS used to normalize | Molecule ID | Normalized assay signal for Ide85 mutants plated against IdeS and Ide85 used to normalize | Molecule ID | Normalized assay signal for IdeZ mutants plated against IdeS and IdeZ used to normalize |
| PRT-12 | 0.42 | | | | |
| PRT-188 | 0.36 | | | | |
| PRT-189 | 0.88 | | | | |
| PRT-190 | 0.81 | | | | |
| PRT-191 | 0.74 | | | | |
| PRT-192 | 0.46 | | | | |
| PRT-193 | 0.43 | | | | |
| PRT-194 | 0.32 | | | | |
| PRT-195 | 0.30 | | | | |

TABLE 18

| | IdeZ2 mutants | | IdeZ mutants | | IdeS mutants |
|---|---|---|---|---|---|
| Molecule ID | Normalized assay signal for IdeZ2 mutants plated against IdeS and IdeS used to normalize | Molecule ID | Normalized assay signal for IdeZ mutants plated against IdeZ and IdeZ used to normalize | Molecule ID | Normalized assay signal for IdeS mutants plated against IdeS and IdeS used to normalize |
| PRT-346 | 1.15 | PRT-313 | 0.86 | PRT-242 | 1.69 |
| PRT-354 | 1.13 | PRT-314 | 1.11 | PRT-243 | 1.41 |
| PRT-347 | 1.06 | PRT-307 | 1.22 | PRT-244 | 0.79 |
| PRT-355 | 1.08 | PRT-315 | 1.21 | PRT-259 | 0.51 |
| PRT-348 | 1.05 | PRT-308 | 1.21 | PRT-260 | 0.53 |
| PRT-349 | 1.08 | PRT-310 | 1.40 | PRT-249 | 0.95 |
| PRT-362 | 1.03 | PRT-321 | 0.99 | PRT-257 | 0.91 |
| PRT-363 | 1.00 | PRT-322 | 1.13 | PRT-250 | 0.96 |
| PRT-356 | 1.01 | PRT-323 | 0.73 | PRT-258 | 0.74 |
| PRT-364 | 1.05 | PRT-316 | 1.26 | PRT-251 | 0.53 |
| PRT-357 | 1.17 | PRT-324 | 1.19 | PRT-252 | 0.52 |
| PRT-365 | 1.13 | PRT-317 | 1.54 | PRT-273 | 0.50 |
| PRT-370 | 1.11 | PRT-325 | 1.52 | PRT-274 | 0.54 |
| PRT-371 | 1.11 | PRT-318 | 1.26 | PRT-275 | 0.50 |
| PRT-374 | 1.06 | PRT-326 | 1.02 | PRT-268 | 0.64 |
| PRT-375 | 1.06 | PRT-319 | 0.90 | PRT-526 | 1.35 |
| PRT-373 | 0.60 | PRT-341 | 3.48 | PRT-599 | 1.38 |
| | | PRT-688 | 2.58 | PRT-600 | 0.84 |
| | | PRT-618 | 1.70 | PRT-590 | 1.17 |
| | | PRT-614 | 1.39 | PRT-578 | 1.16 |
| | | PRT-670 | 2.16 | PRT-589 | 0.72 |
| | | PRT-677 | 1.47 | PRT-558 | 1.28 |
| | | PRT-662 | 2.77 | PRT-597 | 1.14 |
| | | PRT-667 | 0.99 | PRT-601 | 1.13 |
| | | PRT-609 | 1.09 | PRT-579 | 1.10 |
| | | PRT-604 | 1.28 | PRT-546 | 1.29 |
| | | PRT-612 | 3.76 | PRT-530 | 1.34 |
| | | PRT-606 | 4.21 | PRT-551 | 1.21 |
| | | PRT-607 | 2.22 | PRT-592 | 1.41 |
| | | PRT-608 | 3.17 | PRT-562 | 0.82 |
| | | PRT-610 | 3.52 | PRT-548 | 1.19 |
| | | PRT-611 | 2.38 | PRT-593 | 0.74 |
| | | PRT-605 | 1.88 | PRT-569 | 0.69 |
| | | PRT-603 | 2.51 | PRT-245 | 1.27 |
| | | PRT-624 | 2.53 | PRT-246 | 2.70 |
| | | PRT-643 | 2.01 | PRT-262 | 0.58 |
| | | PRT-646 | 3.32 | PRT-264 | 0.73 |
| | | PRT-658 | 3.58 | PRT-253 | 1.08 |
| | | PRT-623 | 2.69 | PRT-254 | 0.50 |
| | | PRT-637 | 1.17 | PRT-248 | 1.11 |
| | | PRT-625 | 2.22 | PRT-256 | 0.58 |
| | | PRT-644 | 2.84 | PRT-277 | 0.53 |
| | | PRT-647 | 2.29 | PRT-278 | 0.66 |
| | | PRT-650 | 3.56 | PRT-279 | 0.77 |
| | | PRT-631 | 3.84 | PRT-270 | 0.94 |

TABLE 18-continued

| IdeZ2 mutants | | IdeZ mutants | | IdeS mutants | |
|---|---|---|---|---|---|
| Molecule ID | Normalized assay signal for IdeZ2 mutants plated against IdeS and IdeS used to normalize | Molecule ID | Normalized assay signal for IdeZ mutants plated against IdeZ and IdeZ used to normalize | Molecule ID | Normalized assay signal for IdeS mutants plated against IdeS and IdeS used to normalize |
| | | PRT-626 | 3.67 | PRT-271 | 1.71 |
| | | PRT-645 | 2.62 | PRT-272 | 0.85 |
| | | PRT-649 | 0.77 | PRT-598 | 1.09 |
| | | PRT-638 | 0.61 | PRT-602 | 1.03 |
| | | PRT-628 | 2.30 | PRT-577 | 1.08 |
| | | PRT-656 | 1.93 | PRT-585 | 1.25 |
| | | PRT-648 | 0.53 | PRT-594 | 0.89 |
| | | PRT-627 | 1.53 | PRT-598 | 1.19 |
| | | PRT-622 | 3.44 | PRT-602 | 1.13 |
| | | PRT-639 | 2.86 | PRT-482 | 0.78 |
| | | PRT-629 | 0.89 | PRT-483 | 0.78 |
| | | PRT-620 | 2.42 | PRT-493 | 0.61 |
| | | PRT-659 | 1.06 | PRT-487 | 0.76 |
| | | PRT-640 | 2.69 | PRT-484 | 0.64 |
| | | PRT-634 | 2.97 | PRT-488 | 0.67 |
| | | PRT-632 | 1.55 | PRT-490 | 0.59 |
| | | PRT-630 | 2.45 | PRT-456 | 0.70 |
| | | PRT-621 | 2.42 | PRT-446 | 0.81 |
| | | PRT-657 | 2.51 | PRT-480 | 1.20 |
| | | PRT-642 | 1.00 | PRT-468 | 1.32 |
| | | PRT-633 | 3.07 | PRT-454 | 0.63 |
| | | PRT-651 | 1.23 | PRT-448 | 0.48 |
| | | PRT-641 | 2.02 | PRT-478 | 0.50 |
| | | PRT-692 | 1.55 | PRT-476 | 0.46 |
| | | PRT-696 | 1.36 | PRT-466 | 1.15 |
| | | PRT-695 | 2.50 | PRT-455 | 1.08 |
| | | PRT-697 | 1.56 | PRT-479 | 1.28 |
| | | PRT-690 | 3.76 | PRT-477 | 1.52 |
| | | PRT-687 | 1.60 | PRT-467 | 1.14 |
| | | PRT-686 | 3.29 | PRT-471 | 1.21 |
| | | PRT-683 | 2.94 | PRT-464 | 1.28 |
| | | PRT-680 | 2.88 | PRT-453 | 0.80 |
| | | PRT-681 | 2.66 | PRT-481 | 1.31 |
| | | PRT-684 | 1.93 | PRT-474 | 1.35 |
| | | PRT-617 | 0.78 | PRT-465 | 1.33 |
| | | PRT-613 | 1.24 | PRT-463 | 1.46 |
| | | PRT-616 | 1.79 | PRT-447 | 1.10 |
| | | PRT-615 | 1.80 | PRT-472 | 1.01 |
| | | PRT-661 | 1.96 | PRT-473 | 1.34 |
| | | PRT-675 | 1.61 | PRT-459 | 1.43 |
| | | PRT-673 | 0.95 | PRT-457 | 1.22 |
| | | PRT-676 | 0.90 | PRT-449 | 1.06 |
| | | PRT-669 | 1.93 | PRT-475 | 1.51 |
| | | PRT-664 | 2.56 | PRT-469 | 1.24 |
| | | PRT-674 | 0.54 | PRT-461 | 1.72 |
| | | PRT-672 | 1.54 | PRT-549 | 0.59 |
| | | PRT-668 | 0.40 | PRT-531 | 0.95 |
| | | PRT-666 | 2.12 | PRT-570 | 1.22 |
| | | PRT-671 | 0.57 | PRT-557 | 1.03 |
| | | PRT-665 | 1.75 | PRT-572 | 1.03 |
| | | PRT-663 | 2.12 | PRT-550 | 1.27 |
| | | PRT-679 | 0.84 | PRT-565 | 0.49 |
| | | | | PRT-563 | 0.72 |
| | | | | PRT-568 | 0.92 |
| | | | | PRT-564 | 0.56 |
| | | | | PRT-451 | 0.86 |
| | | | | PRT-289 | 0.87 |
| | | | | PRT-297 | 0.62 |
| | | | | PRT-291 | 1.14 |
| | | | | PRT-294 | 0.60 |
| | | | | PRT-295 | 0.97 |
| | | | | PRT-296 | 0.72 |
| | | | | PRT-298 | 1.15 |
| | | | | PRT-306 | 0.75 |
| | | | | PRT-299 | 0.95 |
| | | | | PRT-300 | 1.02 |
| | | | | PRT-302 | 0.73 |
| | | | | PRT-286 | 0.55 |
| | | | | PRT-287 | 0.77 |
| | | | | PRT-280 | 1.25 |

TABLE 18-continued

| IdeZ2 mutants | | IdeZ mutants | | IdeS mutants | |
|---|---|---|---|---|---|
| Molecule ID | Normalized assay signal for IdeZ2 mutants plated against IdeS and IdeS used to normalize | Molecule ID | Normalized assay signal for IdeZ mutants plated against IdeZ and IdeS used to normalize | Molecule ID | Normalized assay signal for IdeS mutants plated against IdeS and IdeS used to normalize |
| | | | | PRT-288 | 0.50 |
| | | | | PRT-525 | 0.71 |
| | | | | PRT-522 | 0.67 |
| | | | | PRT-518 | 0.57 |
| | | | | PRT-523 | 0.85 |
| | | | | PRT-519 | 0.91 |
| | | | | PRT-521 | 0.98 |
| | | | | PRT-520 | 0.86 |
| | | | | PRT-524 | 0.51 |
| | | | | PRT-512 | 1.01 |
| | | | | PRT-506 | 1.04 |
| | | | | PRT-502 | 0.58 |
| | | | | PRT-494 | 0.79 |
| | | | | PRT-513 | 1.05 |
| | | | | PRT-508 | 1.14 |
| | | | | PRT-496 | 0.62 |
| | | | | PRT-504 | 0.74 |
| | | | | PRT-514 | 1.19 |
| | | | | PRT-500 | 0.64 |
| | | | | PRT-511 | 0.46 |
| | | | | PRT-498 | 1.08 |
| | | | | PRT-515 | 1.06 |

TABLE 19

| IdeZ mutants | | Ide85 mutants | |
|---|---|---|---|
| Molecule ID | Normalized assay signal for IdeZ mutants plated against IdeS and IdeS used to normalize | Molecule ID | Normalized assay signal for Ide85 mutants plated against IdeS and IdeS used to normalize |
| PRT-313 | 0.48 | PRT-289 | 0.87 |
| PRT-314 | 0.47 | PRT-297 | 0.62 |
| PRT-307 | 0.50 | PRT-291 | 1.14 |
| PRT-315 | 0.40 | PRT-294 | 0.60 |
| PRT-308 | 0.52 | PRT-295 | 0.97 |
| PRT-310 | 0.42 | PRT-305 | 0.72 |
| PRT-321 | 0.52 | PRT-298 | 1.15 |
| PRT-322 | 0.57 | PRT-306 | 0.75 |
| PRT-323 | 0.47 | PRT-299 | 0.95 |
| PRT-316 | 0.67 | PRT-300 | 1.02 |
| PRT-324 | 0.52 | PRT-302 | 0.73 |
| PRT-317 | 0.57 | PRT-286 | 0.55 |
| PRT-325 | 0.59 | PRT-287 | 0.77 |
| PRT-318 | 0.66 | PRT-280 | 1.25 |
| PRT-326 | 0.51 | PRT-288 | 0.50 |
| PRT-319 | 0.57 | PRT-525 | 0.71 |
| PRT-327 | 0.56 | PRT-522 | 0.67 |
| PRT-320 | 0.55 | PRT-518 | 0.57 |
| PRT-329 | 0.46 | PRT-523 | 0.85 |
| PRT-330 | 0.53 | PRT-519 | 0.91 |
| PRT-331 | 0.54 | PRT-521 | 0.98 |
| PRT-332 | 0.55 | PRT-520 | 0.86 |
| PRT-333 | 0.48 | PRT-524 | 0.51 |
| PRT-328 | 0.59 | PRT-512 | 1.01 |
| PRT-344 | 0.90 | PRT-506 | 1.04 |
| PRT-338 | 1.88 | PRT-502 | 0.58 |
| PRT-339 | 1.49 | PRT-494 | 0.79 |
| PRT-340 | 2.00 | PRT-513 | 1.05 |
| PRT-341 | 1.92 | PRT-508 | 1.14 |
| PRT-636 | 0.63 | PRT-496 | 0.62 |
| PRT-693 | 0.75 | PRT-504 | 0.74 |
| PRT-682 | 0.77 | PRT-514 | 1.19 |
| PRT-685 | 1.00 | PRT-500 | 0.64 |
| PRT-688 | 0.76 | PRT-511 | 0.46 |
| PRT-618 | 0.64 | PRT-498 | 1.08 |
| PRT-614 | 0.49 | PRT-515 | 1.06 |
| PRT-670 | 0.96 | | |
| PRT-677 | 0.76 | | |
| PRT-662 | 0.75 | | |
| PRT-667 | 0.55 | | |
| PRT-609 | 0.62 | | |
| PRT-604 | 0.50 | | |
| PRT-612 | 0.82 | | |
| PRT-606 | 0.96 | | |
| PRT-607 | 0.58 | | |
| PRT-608 | 0.88 | | |
| PRT-610 | 0.71 | | |
| PRT-611 | 0.64 | | |
| PRT-605 | 0.66 | | |
| PRT-603 | 0.61 | | |
| PRT-624 | 0.80 | | |
| PRT-643 | 0.67 | | |
| PRT-646 | 0.67 | | |
| PRT-658 | 0.95 | | |
| PRT-623 | 0.71 | | |
| PRT-637 | 0.59 | | |
| PRT-625 | 0.77 | | |
| PRT-644 | 0.81 | | |
| PRT-647 | 0.57 | | |
| PRT-650 | 1.01 | | |
| PRT-631 | 0.84 | | |
| PRT-626 | 0.85 | | |
| PRT-645 | 0.68 | | |
| PRT-649 | 0.61 | | |
| PRT-638 | 0.49 | | |
| PRT-628 | 0.61 | | |

TABLE 19-continued

| | IdeZ mutants | | Ide85 mutants |
|---|---|---|---|
| Molecule ID | Normalized assay signal for IdeZ mutants plated against IdeS and IdeS used to normalize | Molecule ID | Normalized assay signal for Ide85 mutants plated against IdeS and IdeS used to normalize |
| PRT-656 | 0.54 | | |
| PRT-648 | 0.43 | | |
| PRT-627 | 0.58 | | |
| PRT-622 | 1.01 | | |
| PRT-639 | 0.82 | | |
| PRT-629 | 0.46 | | |
| PRT-620 | 0.77 | | |
| PRT-659 | 0.43 | | |
| PRT-640 | 0.66 | | |
| PRT-634 | 0.71 | | |
| PRT-632 | 0.49 | | |
| PRT-630 | 0.60 | | |
| PRT-621 | 0.55 | | |
| PRT-657 | 0.78 | | |
| PRT-642 | 0.52 | | |
| PRT-633 | 0.60 | | |
| PRT-651 | 0.53 | | |
| PRT-641 | 1.14 | | |
| PRT-692 | 0.70 | | |
| PRT-696 | 0.74 | | |
| PRT-695 | 0.84 | | |
| PRT-697 | 0.69 | | |
| PRT-690 | 0.92 | | |
| PRT-687 | 0.44 | | |
| PRT-686 | 0.72 | | |
| PRT-683 | 0.71 | | |
| PRT-680 | 0.81 | | |
| PRT-679 | 0.44 | | |
| PRT-681 | 1.30 | | |
| PRT-684 | 1.41 | | |
| PRT-617 | 1.82 | | |
| PRT-613 | 2.07 | | |
| PRT-616 | 1.15 | | |
| PRT-615 | 1.36 | | |
| PRT-661 | 0.97 | | |
| PRT-675 | 0.87 | | |
| PRT-673 | 1.84 | | |
| PRT-676 | 1.67 | | |
| PRT-669 | 0.86 | | |
| PRT-664 | 0.64 | | |
| PRT-674 | 1.66 | | |
| PRT-672 | 1.02 | | |
| PRT-668 | 2.36 | | |
| PRT-666 | 0.77 | | |
| PRT-671 | 2.41 | | |
| PRT-665 | 0.96 | | |
| PRT-663 | 1.05 | | |

Figure 6:
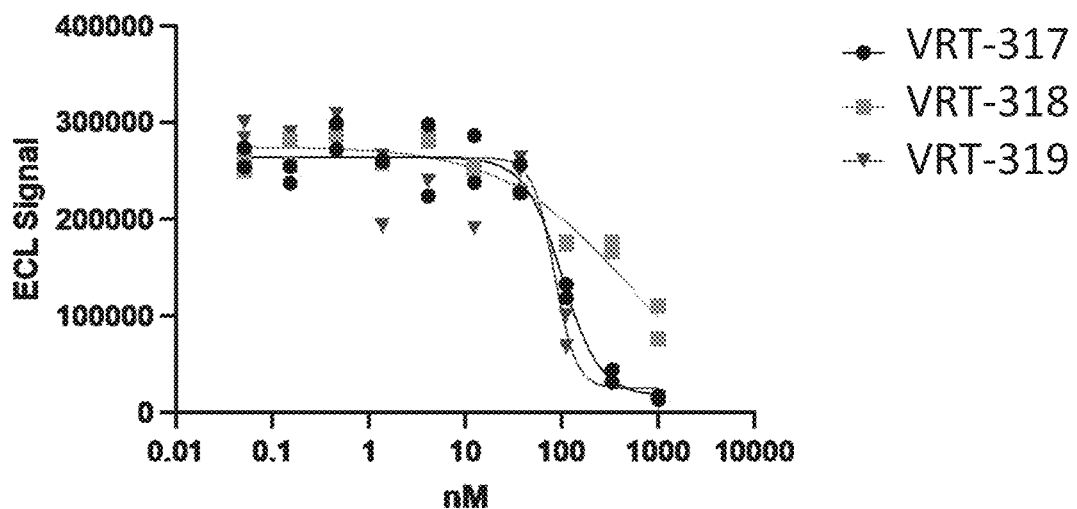
FIG. 6 shows results of a human plasma cleavage assay.
Figure 6:
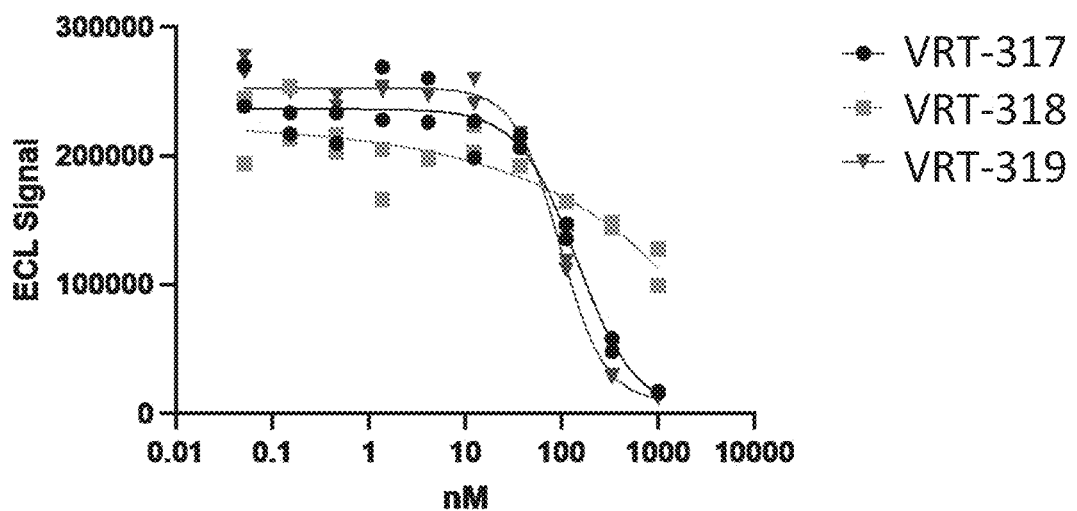
Figure 7A:
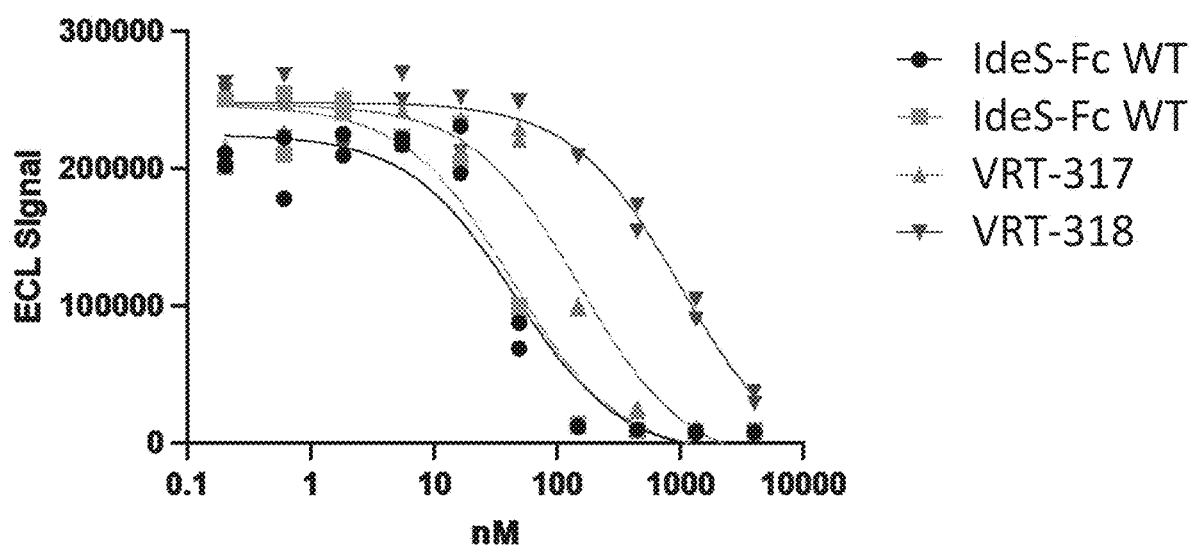
FIGS. 7A and 7B show results of a human plasma cleavage assay.
Figure 7A:
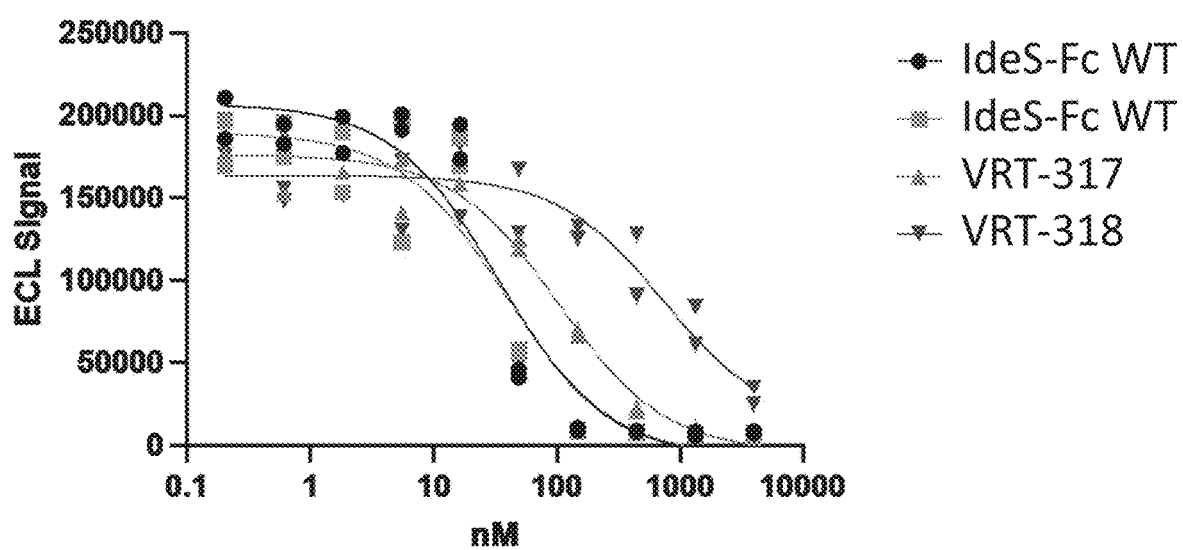
Figure 7B:
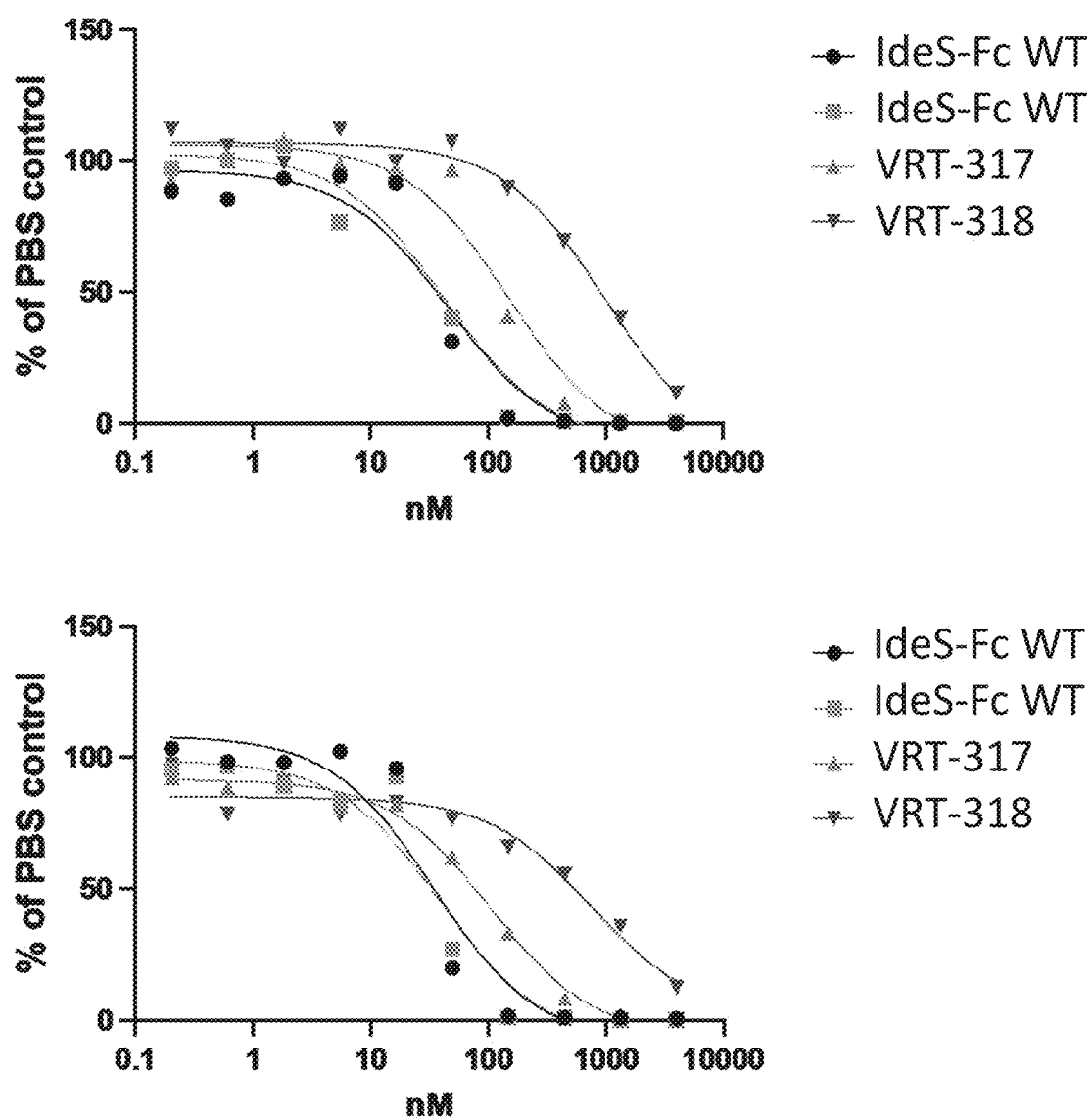

Example 14: Polypeptides Having Protease Activity have Higher EC50 than Wild Type IdeS or IdeZ in Human Plasma Cleavage Assay The test articles produced in CHO cells were first purified using standard protein purification methods, and then quantified using a protein assay kit. In a series of separate experiments, the human plasma was mixed with the purified test articles at concentrations ranging from 0.1 nM to 1000 nM. The mixtures were incubated overnight to allow the protease to cleave the immunoglobulins present in the plasma. After incubation, the remaining immunoglobulins were quantified. The EC50, or the concentration of the test article at which 50% of the immunoglobulins are cleaved, is calculated from a dose-response curve. The data shown in FIG. 6, and FIGS. 7A and 7B, and in tables below (each table showing data from the same experiment) shows that test articles have higher EC50 than Fc-IdeS WT or Fc-IdeZ WT molecules.

| | EC50 (nM) | | | | |
|---|---|---|---|---|---|
| Donor | Fc-IdeS WT | VRT-317 | VRT-318 | Fc-IdeZ WT | VRT-319 |
| 1 | 40 | 25 | 270 | 48 | 135 |
| 2 | 75 | 40 | 350 | | 150 |
| 3 | 72 | 30 | 362 | | 100 |
| 4 | 40 | 25 | 181 | | |
| 5 | 45 | 42 | 125 | | |
| 6 | 26 | | | | |
| 7 | 48 | | | | |
| 8 | 14 | | | | |
| 9 | 37 | | | | |
| 10 | 32 | | | | |
| 11 | 21 | | | | |
| 12 | 92 | | | | |
| Average | 45 | 32 | 258 | 48 | 128 |

| Donor | EC50 (nM) Fc-IdeS WT (parent, Seismic) | EC50 (nM) Fc-IdeS WT (parent, CHO KEMP) | EC50 (nM) VRT-317 (CHO KEMP) | EC50 (nM) VRT-318 (CHO KEMP) | EC50 (nM) VRT-275 |
|---|---|---|---|---|---|
| 1 | 45 | 42 | 151 | 990 | 84 |
| 2 | 34 | 38 | 102 | 740 | 95 |

Figure 8:
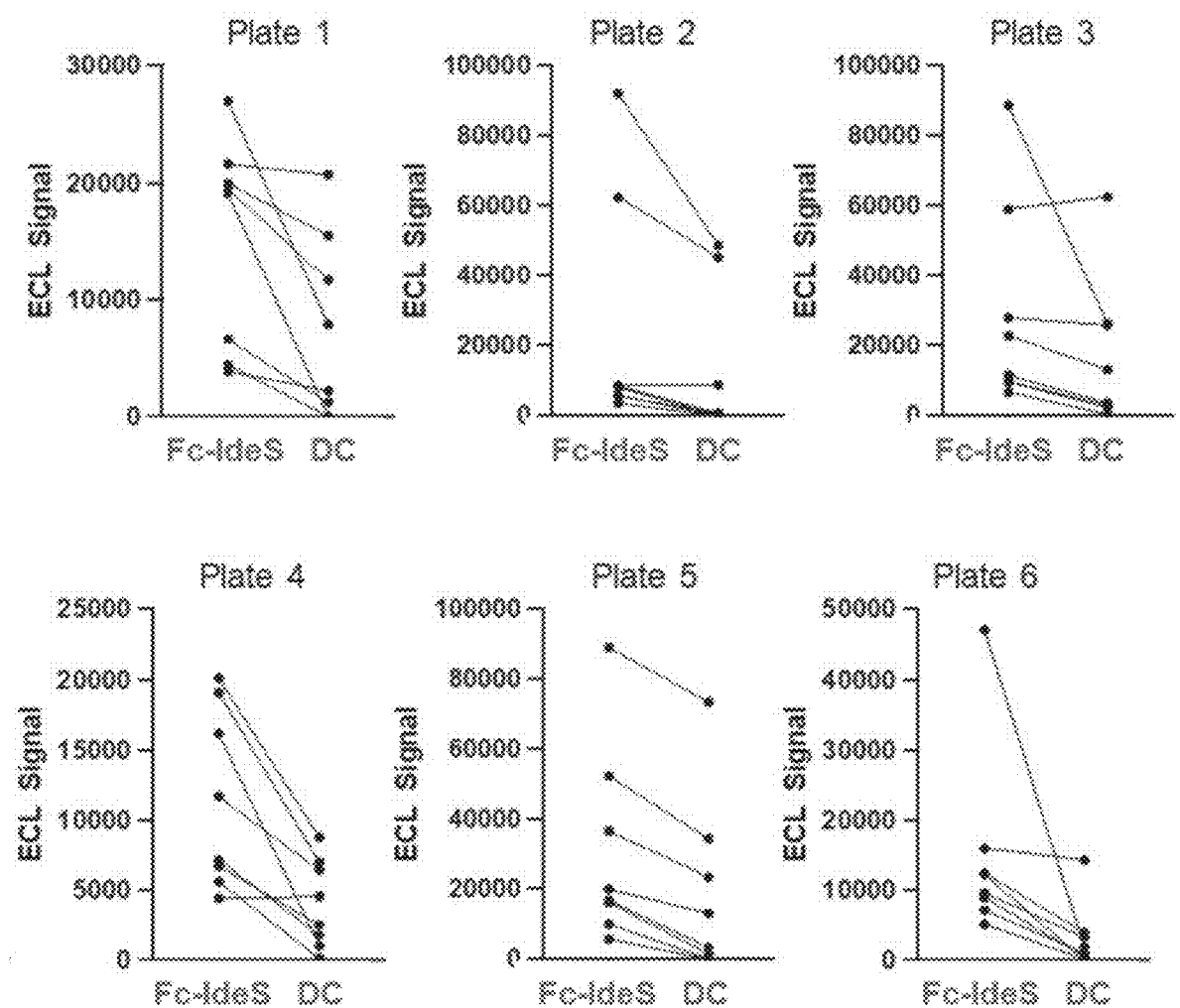
FIG. 8 shows decreased levels of pre-formed IgG binding to protease variants relative to wild-type Fc-IdeS.

Example 15: VRT-275 Demonstrates Reduced Immunogenicity Compared to Wildtype IdeS-Fc 48 human donors were evaluated for pre-existing antibody binding to VRT-275 relative to wild type Fc-IdeS through an electrochemiluminescence (ECL) immunoassay. 93.75% of donor cells exhibited a lower levels of pre-formed IgG binding to the test article relative to WT Fc-IdeS, measured by ECL signal, as shown in FIG. 8.

Example 16: In Vivo PK/PD of VRT-275 Shows Greater than 90% Reduction in Human IVIG at 30 min after Dosing C57/BL6 mice were administered intravenous immune globulin (IVIG) at a dose of 450 mg/kg, and randomized based on body weight for treatment with VRT-275 administered intravenously at various doses, or a vehicle control (PBS). Treatment was administered at 1 hour following administration of IVIG. Blood was collected at 0.5 hours, 2 hours, 4 hours, 24 hours, 48 hours, and 72 hours following treatment. VRT-275 had a half-life extending for at least 24 hours, and showed a greater than 90% reduction of IVIG at all tested timepoints and at both treatment doses relative to vehicle treated animals.

Example 17: In Vivo PK/PD of an Fc-Protease Shows Greater than 95% Reduction in Human IVIG at 30 min after Dosing C57/BL6 animals were administered IVIG at a dose of 450 mg/kg, and randomized based on body weight for treatment with a VFC-5 fused to an exemplary protease administered intravenously, or a vehicle control (PBS). Treatment was administered 1 hour following administration of IVIG. Blood was collected at 0.5 hours, 2 hours, 4 hours, 24 hours, 48 hours, and 72 hours following treatment. The VFC-5 fused to an exemplary protease showed a half-life extending 24 hours, and greater than 95% reduction in blood IVIG at all tested timepoints relative to vehicle treated animals.

Example 18: VRT-317 Inhibits ADCC

Antibody dependent cellular cytotoxicity (ADCC) was evaluated in cell. Cells were opsonized with trastuzumab (Herceptin) at a fixed concentration for 30 minutes. Cells were then treated with a dose response of VRT-317 for 2 hours. VRT-317 inhibited ADCC at all concentrations tested illustrating that the protease was able to cleave the antibody and demonstrating its ability to be able to cleave different types of antibodies.

The examples and embodiments provided for herein demonstrate the unexpected and surprising results of the variants and proteins provided for herein. The molecules demonstrate polypeptides that have increased half-life when conjugated to a protease resistant Fc as well as proteases that are less immunogenic as compared to other proteases such as wild-type IdeS or imlifidase. By providing a proteins that are less immunogenic and/or have a longer half-life in vivo the products can be administered more than once as well as less frequently to, for example, achieve a therapeutic effect, such as reducing immunoglobulins in a subject. Without being bound to any particular theory, the reduction of immunoglobulins can lead to the treatment or a therapeutic effect in subjects with auto-immune disease, such as those provided for herein.

The disclosures of each and every patent, patent application, and publication cited herein are hereby incorporated herein by reference in their entirety. While various embodiments have been disclosed with reference to specific aspects, it is apparent that other aspects and variations of these embodiments may be devised by others skilled in the art without departing from the true spirit and scope of the embodiments. The appended claims are intended to be construed to include all such aspects and equivalent variations.

---

SEQUENCE LISTING (1358 sequences)

SEQ ID NO: 1 - protein, 330 aa, synthetic construct [sequence omitted]

SEQ ID NO: 2 - protein, 326 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 3 - protein, 377 aa, synthetic construct
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 4 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5 - protein, 23 aa, synthetic construct
EPKSCDKTHTCPPCPAPELLGGP

SEQ ID NO: 6 - protein, 25 aa, synthetic construct
ELKTPLGDTTHTCPRCPAPELLGGP

SEQ ID NO: 7 - protein, 70 aa, synthetic construct
ELKTPLGDTTHTCPRCPEPKSCDTPPPCPRCPEPKSCDTPPPCPRCPEPKSCDTPPPCPRCPAPELLGGP

SEQ ID NO: 8 - protein, 20 aa, synthetic construct
ESKYGPPCPSCPAPEFLGGP

SEQ ID NO: 9-18 - skipped (10 entries)

SEQ ID NO: 19 - protein, 227 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 227 aa, synthetic construct
DKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 227 aa, synthetic construct
DKTHTCPPCPAPEAAGAPSVFLFPPKPKDTLMISRTPEVTCVVVKVSHSDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 227 aa, synthetic construct
DKTHTCPPCPAPEAAGAPSVFLFPPKPKDTLMISRTPEVTCVVVKVSHSDPEVKFNWYVDGVEVHNAKTKPREEQQNKTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 226 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 24 - protein, 226 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 25 - protein, 226 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 26 - protein, 306 aa, synthetic construct
ANQEIRYSEVTPYHVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 27 - protein, 8 aa, synthetic construct
HHHHHHHH

SEQ ID NO: 28 - protein, 306 aa, synthetic construct
ANQEIRYSEVTPYHVTSVWTKNVTPPAQFTQGEDVFHAPYVANQGWYDITKTFNGKDDLLCGAATAGNMLHWWFDQNKDQIKRYLEEHPEKQKINFNGSQMFDVKEAIDTKNHQLDSKLFEYFKEKAFPYLSTKHLGVFPDHVIDMFINGYRLSLNNSGPTPVKNGSKDPRGGIFDAVFTRGDQSKLLTSRHDFKNKSLKEISDLIKKELTEGKALGLSHTYANVRINHVINLWGADFDSNGTLKAIYVTDSDSNASIGMKKYFVGVNNATKVAISAKEIKENNTGAQVLGLFTLSTGQDSWNQTN

SEQ ID NO: 29 - protein, 306 aa, synthetic construct
ANQEIRYSEVTPYHVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNAQIGMKKYFVGVNSAGKVAISAKEIKEDNIGAQVLGLFTLSTGQDSWNQTN

SEQ ID NO: 30 - protein, 125 aa, synthetic construct
QVQLQESGGGLVQAGGSLRLSCAASGYISDAYYMGWYRQAPGKEREFVATITHGTNTYYADSVKGRFTISRDNAKNTVYLQMNSLKPEDTAVYYCAVLETRSYSFRYWGQGTQVTVSSLEGGGGS

SEQ ID NO: 31 - protein, 311 aa, synthetic construct
ANQEIRYSEVTPYHVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNAQIGMKKYFVGVNSAGKVAISAKEIKEDNIGAQVLGLFTLSTGQDSWNQTNGGGGS

SEQ ID NO: 32 - protein, 122 aa, synthetic construct
QVQLQESGGGLVQAGGSLRLSCAASGYISDAYYMGWYRQAPGKEREFVATITHGTNTYYADSVKGRFTISRDNAKNTVYLQMNSLKPEDTAVYYCAVLETRSYSFRYWGQGTQVTVSSLEGG

SEQ ID NO: 33 - protein, 120 aa, synthetic construct
QVQLQESGGGLVQAGGSLRLSCAASGYISDAYYMGWYRQAPGKEREFVATITHGTNTYYADSVKGRFTISRDNAKNTVYLQMNSLKPEDTAVYYCAVLETRSYSFRYWGQGTQVTVSSLE

SEQ ID NO: 34 - protein, 6 aa, synthetic construct
HHHHHH

SEQ ID NO: 35 - protein, 339 aa, synthetic construct
MRKRCYSTSAAVLAAVTLFVLSVDRGVIADSFSANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 36 - protein, 306 aa, synthetic construct
ANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 37 - protein, 315 aa, synthetic construct
DDYQRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHRHVAISAKKIEGENIGAQVLGLFTLSSGKDIWQKLS

SEQ ID NO: 38 - protein, 315 aa, synthetic construct
DDYQRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 39 - protein, 344 aa, synthetic construct
EVVEVWPNGQNPNGKIEILSQTEHSEHLQKLRDIEDFQAQKQADHVRYTKWLDGVTVDEHEFRKIKEYDTEYYVTPLLSGKGYYDINKDFNQDSDKCAAAVAANMFHYWFDRNRDSINRFLSQSPGENGVIKLENEKTIEVSKFLETYRSDGDYLDKSPFFDLISNSFKGPVWANKLLDAYINGYGYIHKFAKNTPHSKNNNSKFNFFKKVFDGNLLTDIHQIFDYNTFSDKLSEALYTGKAIGLAYGPGDLRRSLGHIISVWGADLDDQNRVVAIYVTDSDDKKLTIGNERVGLKRYKVSSDDQGRARLTTRDKDNTGGEIRSIETLDMGTQEWADYFNKTEK

SEQ ID NO: 40 - protein, 352 aa, synthetic construct
EVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 41 - protein, 306 aa, synthetic construct
RNQITTYSEATPSHITSIWTKGVTPPTNFIEGTDGSHAPYIANQGWYDITKTFNGKDDLLCAAATAGNMLHWWFDQNKNQIEGYLTEHPEKQAIIFNGEKMFDVKEAISTKDRQLDSKLFEYFKEKAFPTLSARRRGVFPDHVIDMFINGYRLSLDNYDKTPVKEGNKDLRGGIFDQVFTRGDQSKLLTNRYNLRTKTINEISQLIKQELIAGKALAISHTYNNIGISHVINLWGADFNSEGNLEAIYVTDSDSNASIGMKKYYVGVNSAGEVAVSSKKIDSEHLGAAALGLYTLSAGQGIWHQTN

SEQ ID NO: 42 - protein, 227 aa, synthetic construct
DKTHTSPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 227 aa, synthetic construct
DKTHTSPPSPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 227 aa, synthetic construct
DKTHTCPPCPAPELLGDSGVFLFPPKPKDTLMISRTPEVTCVVVDVSHDEPEVKFNWYVDGVEVHNAKTKPREEQYNSTYRVVSVLTVLHQDWLNGKEYKCKVSNKALPRPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 227 aa, synthetic construct
DKTHTCPPCPAPEFEGGPSVFLFPPKPKDTLMISRTPEVTCVVVDVSDEDGEVKFNWYVDGVEVHNAKTKPREEQYNSTYRVVSVLTVLHQDWLNGKEYKCKVSNKALAAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 46 - protein, 227 aa, synthetic construct
DKTHTCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKALPSSIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 227 aa, synthetic construct
DKTHTCPPCPAPEFEGGPSVFLFPPKPKDTLMISRTPEVTCVVVDVSDEDGEVQFNWYVDGVEVHNAKTKPREEQFNSTYRVVSVLTVLHQDWLNGKEYKCKVSNKALASSIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 48 - protein, 227 aa, synthetic construct
DKTHTSPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 227 aa, synthetic construct
DKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 306 aa, synthetic construct
ANQEIRYSNVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 51 - protein, 306 aa, synthetic construct
ANQEIRYSEVTPYHNTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGSLKAIYVTDSDSNASIGMKKYFVGVNSAGKVAISAKEIKEDNIGAQVLGLFTLSTGQDSWNQTN

SEQ ID NO: 52 - protein, 311 aa, synthetic construct
RNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 53 - protein, 20 aa, synthetic construct
METDTLLLWVLLLWVPGSTG

SEQ ID NO: 54 - protein, 32 aa, synthetic construct
MNIQERFSLRKSAVGLVSVSLLCAIYTSTVAA

SEQ ID NO: 55 - protein, 1109 aa, synthetic construct
DTVVTGVNEIIEESQVKDEVSIESEKNESLDGSNIEIVEEIADNIPSPVIAEGEVAVEMKVDRGTENVVSRNDTEVTTSEQNQIEVTETKEILNQTSYQTESGEQRQIIWAHGITPPAMEQSGGFVKEKYGDYLNYTAPFEAGKGYYDTNKSLNASFIDLNLCFAAVSSNMVHWWLEQNSSYVERYLKEKKGTVNVEENYAITDLRRYINSFQNQQNSRVFDMFKTYYGYRTNGFVSDALVDLFINGYKPKAQGGVNLEDSQLVPDSRGGFFYDVFKEKKLTNRIFSGSYERFGEDVRTVLESKGLLGLTYRTLGYATHIVTVWGAEYDNQGKIKAVYITDSDDQQEQIGLKRMGITRDASGNPRLNNHMKNNSAGALLDYVHTIRLGQDLWEEYFNPLAKAKETASQTLADTKKALDLSIQGQSELPESMRLIYLEKLNNLYNQGILSIQKAESSEMLSGALENGLNSLKSLDFPISEVGNALAPDLPVGDRSTVSDVDSLSSQETSSTNLEADTENAGIIADGTNQLHFPVEAQTTSSVEAEGDNVFEQEADTLPIIIENKDEFGSELSRNMQTSETDSLVVAVEEDVKNDEVAQVEELLESEKVENQSSELLSDTLIVESANDKEEDRVEAVVSEQPDSIPHQNVEISLVEPTNVETETVVTPINDAATPHGSPTYIDNSVTESVATPLEKDSIQAGETEIAEPTSSESTNVETETVVTPVNDVATPHGSPTYIDNSVTESVATPLEKDSIQAGETEIAEPTSSESTNVETETVVTPVNDVATPHGSPTYIDNSVTESVATPLEKDSIQAGETEIAEPTSSESTSVEAELVDNSEIHAATSSVTPCGSSAYADGSTTESVATPLEKDSIQTGNTEIAEPTSSKSTNVEAASVDNSEIHADASLTAVSSVNLDNPVIEPVAISLIGSKRDTNAEVEVSSLSKREVRKTNTDGLISVQSKVIKKELLESSLAEAGSPLLEATIAQSSNSNSTEIGMSYQNTVLLESNNTERQVSKAEIVMEHKETELVETVSSASEPVVLVENISQTSNNTIESGKNMGVQSQAGAKQILGVEQSSKVSTPTSRQIMGVGLLTLVLGSALGLLKKRRK

SEQ ID NO: 56 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 57 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 58 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 59 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKEQIERYLKEHPEKQKINFNGEQMFDVKEAIDTKDSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALALSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 60 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKKHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLEAIYVTDSDSNASIGMKKYFVGVNSAGKVAISAKEIKEDNIGAQVLGLFTLSTGQDIWNQTN

SEQ ID NO: 61 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKEQIERYLKEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIEGDNIGAQVLGLFTLSTGQDIWNQTN

SEQ ID NO: 62 - protein, 307 aa, synthetic construct
MANQEIRYSEETPYHVTSVWTKGVTPPANFTQGEDVFHAPYVANQGWYDITKTFNGKDDLLCGAATAGNMLHWWFDQNKDQIERYLKKHPEKQKINFNGEQMFDVKEAIDTKDSQTDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWEQTN

SEQ ID NO: 63 - protein, 307 aa, synthetic construct
MANQEIRYSEVTPYHVTSVWTKGVTPPTNFTQGEDVFHAPYIANQGWYDITKTFNGKDDLLCGAATAGNMLHWWFDQNKDQIERYLKEHPEKQKINFNGEQMFDVKEAIDTKNSQLDSKLFEYFKEKAFPYLSTKHLGVFPDHVLDMFINGYRLSLTNHGPTPVKEGSKDPRGGIFDAVFTRGDQSKLLTSRHDFKEKNLKEISDLIKQELTEGKALGLSHTYANVRINHVINLWGADFDSNGNLEAIYVTDSDSNASIGMKKYFVGVNSAGKVAISAKEIKDDNIGAQVLGLFTLSTGQDIWNQTN

SEQ ID NO: 64 - protein, 307 aa, synthetic construct
MANQEIRYSEETPYHVTSVWTKGVTPPANFTQGEDVFHAPYVANQGWYDITKTFNGKDDLLCGAATAGNMLHWWFDQNKEQIERYLKEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKTLKEISDLIKKELTEGKALALSHTYANVRINHVINLWGADFDSNGNLKAIYVTDSDSNASIGMKKYFVGVNSAGKVAISAKEIKEDNIGAQVLGLFTLSSGQDIWNQTN

SEQ ID NO: 65 - protein, 307 aa, synthetic construct
MANQEIRYSEVTPYTVTSVWTKGVTPPANFTQGEDVFHAPYVANQGWYDITKTFNGKDDLLCGAATAGNMLHWWFDQNKEQIERYLKEHPEKQKINFNGEQMFDVKEAIDTKDSQLDSELFEYFKEKAFPYLSTKHLGVFPDHVIDMFINGYRLSLTNHGPTPVKEGSKDPRGGIFDAVFTRGDQSKLLTSRHDFKEKTLKEISDLIKKELTEGKALALSHTYANVRINHVINLWGADFDSEGNLEAIYVTDSDSNASIGMKKYFVGVNSAGKVAISAKEIEDDNIGAQVLGLFTLSTGQDIWNQTN

SEQ ID NO: 66 - protein, 307 aa, synthetic construct
MANQEIRYSEETPYHVTSVWTKGVTPPANFTQGEDVFHAPYVANQGWYDITKTFNGKDDLLCGAATAGNMLHWWFDQNKDQIEKYLKEHPEKQKINFNGEQMFDVKEAIDTKDSQTDSKLFEYFKEKAFPYLSTKHLGVFPDHVIDMFINGYRLSLTNHGPTPVKEQSKDPRGGIFDAVFTRGDQSKLLTSRHDFKEKTLKEISDLIKKELSEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 67 - protein, 307 aa, synthetic construct
MANQEIRYSEVTPYHVTSVWTKGVTPPADFTQGEDVFHAPYKANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVIDMFINGYRLSLTNHGPTPVKRGSKDPRGGFFDAVFTRGDQSKLLTSRHDFKEKTLNEISDLIKKELTEGKALGLSHTYANVRINHVINLWGADFDSNGNLEAIYVTDSDSNASIGMKKYFVGVNSAGKVAISAKEIKEDNIGAQVLGLFTLSTGQDIWEQTN

SEQ ID NO: 68 - protein, 307 aa, synthetic construct
MANQEIRYSEETPYHVTSVWTKGVTPPANFTQGEDVFHAPYKANQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTN

SEQ ID NO: 69 - protein, 307 aa, synthetic construct
MANQEIRYSEVTPYTVTSVWTKGVTPPADFTQGEDVFHAPYIANQGWYDITKTFNGKDDLLCGAATAGNMLHWWFDQNKEQIERYLKKHPEKQKINFNGEQMFDVKEAIDTKDSQTDSELFEYFKEKAFPYLSTKHLGVFPDHVLDMFINGYRLSLTNHGPTPVKEGSKDPRGGIFDAVFTRGDQSKLLTNRHDFKEKTLSEISDLIKKELTEGKALGLSHTYANVRINHVINLWGADFDSEGNLEAIYVTDSDSNASIGMKKYFVGVNSAGKVAISAKEIKEDNIGAQVLGLFTLSTGQDIWNQTN

SEQ ID NO: 70 - protein, 307 aa, synthetic construct
MANQEIRYSEVTPYTITSVWTKGVTPPTNFTQGEDVFHAPYVANQGWYDITKTFNGKDDLLCGAATAGNMLHWWFDQNKDEIERYLKEHPEKQKINFNGEQMFDVKEAIDTKDSQTDSKLFEYFKDKAFPYLSTKHLGVFPDHVIDMFINGYRLSLTNHGPTPVKRGSKDPRGGIFDAVFTRGDQSKLLTSRHDFKEKNLNEISDLIKQELTEGKALGLSHTYANVRINHVINLWGADFNSNGNLKAIYVTDSDSNASIGMKKYFVGVNKAGKVAISAKEIKGDNIGAQVLGLFTLSTGQDIWEQTN

SEQ ID NO: 71 - protein, 307 aa, synthetic construct
MANQEIRYSEETPYHITSVWTKGVTPPTDFTQGEDVFHAPYVANQGWYDITKTFNGKDDLLCGAATAGNMLHWWFDQNKDQIERYLKKHPEKQKINFNGEQMFDVKEAIDTKDSQTDSKLFEYFKDKAFPYLSTKHLGVFPDHVLDMFINGYRLNLTNHGPTPVKEGSKDPRGGIFDAVFTRGDQSKLLTSRHDFKEKNLKEISDLIKQELQEGKALGLSHTYANVRINHVINLWGADFDSNGNLKAIYVTDSDSNASIGMKKYYVGVNAAGKVAISAKEIEEDNIGAQVLGLFTLSLGQDIWNQTN

SEQ ID NO: 72 - protein, 307 aa, synthetic construct
MANQEIRYSEVTPYHITSVWTKGVTPPTNFTQGEDVFHAPYKANQGWYDITKTFNGKDDLLCGAATAGNMLHWWFDQNKEEIERYLKEHPEKQKINFNGEQMFDVKEAIDTKGSQTDSKLFNYFKDKAFPYLSTKHLGVFPDHVLDMFINGYRLSLTNHGPTPVKEQSKDPRGGIFDAVFTRGDQSKLLTSRHDFKEKNLKEISDLIKKELTEGKALGLSHTYANVRINHVINLWGADFDSEGNLEAIYVTDSDSNASIGMKKYFVGVNSAGKVAISAKEIKGDNIGAQVLGLFTLSTGQDIWEKTN

SEQ ID NO: 73 - protein, 307 aa, synthetic construct
MANQEIRYSEETPYHVTSVWTKGVTPPTNFTQGEDVFHAPYIANQGWYDITKTFNGKDDLLCGAATAGNMLHWWFDQNKEEIEKYLEEHPEKQKINFNGEQMFDVKEVIDTKDSQLDSKLFEYFKEKAFPYLSTKHLGVFPDHVIDMFINGYRLNLTNHGPTPVKEGSKDPRGGIFDAVFTRGDQSKLLTERHDFKEKTLKEISQLIKQELTEGKALGLSHTYANVRINHVINLWGADFDSEGNLEAIYVTDSDSNASIGMKKYFVGVNSAGKVAISAKEIEEDNIGAQVLGLFTLSTGQDIWEQTN

SEQ ID NO: 74 - protein, 307 aa, synthetic construct
MANQEIRYSEESPSVVTSVWTKGVTPPANFTYGEDVFHAPYIANQGWYDITKTFNGKDDLLCGAATAGNMLHWWFDQNKDEIEAYLKKHPEKQKINFNGEQMFDVKEAIDTKDDQTNSKLFNYFKDKAFPYLSTKHLGVFPDHVLDMFINGYRLNLTNHGPTPVKEGSKDPRGGIFDAVFTRGDQSKLLTSRHDFKEKTLKEISDLIKQELTEGKALGLSHTYANVRINHVINLWGADFNSEGNLKAIYVTDSDSNASIGMKKYFVGVNAAGKVAISAKEIKDDNIGAQVLGLFTLSTGQDIWNQTN

SEQ ID NO: 75 - protein, 307 aa, synthetic construct
MANQEIRYSEATPYHITSVWTKGVTPPANFTQGEDVFHAPYVPNQGWYDITKTFNGKDDLLCGAATAGNMLHWWFDQNKDQIERYLKEHPEKQKINFNGEQMFDVKEAIDTKDSQTDSKLFNYFKEKAFPYLSTKHLGVFPDHVLDMFINGYRLSLTNHGPTPVKEQSKDPRGGIFDAVFTRGDQSTLLTSRHDFKEKTLKEISDLIKKELQEGKALGISHTYANVRINHVINLWGADFNSEGNLEAIYVTDSDSNASIGMKKYYVGVNSAGKVAISAKEIEDDNIGAQVLGLFTLSTGKDIWEQTN

SEQ ID NO: 76 - protein, 307 aa, synthetic construct
MANQEIRYSEVSPSTVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 77 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 78 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKNSQTDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLEAIYVTDSDSNASIGMKKYFVGVNSAGKVAISAKEIKEDNIGAQVLGLFTLSTGQDIWNQTN

SEQ ID NO: 79 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 80 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKQELTEGKALGLSHTYANVRINHVINLWGADFDSNGNLEAIYVTDSDSNASIGMKKYFVGVNSAGKVAISAKEIEEDNIGAQVLGLFTLSTGQDIWNQTN

SEQ ID NO: 81 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTN

SEQ ID NO: 82 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQTDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLEAIYVTDSDSNASIGMKKYFVGVNSAGKVAISAKEIKEDNIGAQVLGLFTLSTGQDSWNQTN

SEQ ID NO: 83 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKDHQLDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 84 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKQELTEGKALGLSHTYANVRINHVINLWGADFDSNGNLEAIYVTDSDSNASIGMKKYFVGVNSAGKVAISAKEIEEDNIGAQVLGLFTLSTGQDSWNQTN

SEQ ID NO: 85 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKKELTEGKALGLSHTYANVRINHVINLWGADFDSEGNLKAIYVTDSDSNASIGMKKYFVGVNSAGKVAISAKEIKEDNIGAQVLGLFTLSTGQDSWNQTN

SEQ ID NO: 86 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIERYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 87 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 88 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLKEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 89 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 90 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKDHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 91 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQTDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 92 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 93 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLEAIYVTDSDSNASIGMKKYFVGVNSAGKVAISAKEIKEDNIGAQVLGLFTLSTGQDSWNQTN

SEQ ID NO: 94 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKQELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 95 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVLDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 96 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDYIDRYLEEHPEKQKINFNGEQMFDVKEAIDTKNSQLDSKLFEYFKEKAFPYLSTKHLGVFPDLVLDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 97 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKQKINFNGEQMFDVKEAIDTKNDQLDSKLFEYFKEKAFPYLSTKHLGVFPDLVIDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 98 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKQKINFNGEQMFDVKEAIDTKNDQTDSKLFEYFKEKAFPYLSTKHLGVFPDLVIDMFINGYRLSLTNHGPTPVKEGSKDPRGGIFDAVFTRGDQSKLLTSRHDLKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 99 - protein, 307 aa, synthetic construct
MANQEIRYSEVTPYHVTSVWTKGVTPPANFTQGEDVFHAPYVANQGWYDITKTFNGGDDLLCGAATAGNMLHWWFDQNKDQIDRYLEEHPEKQKINFNGEQMFDVKEAIDTKNSQTDSKLFEYFKEKAFPYLSTKHLGVFPDLVLDMFINGYRLSLTNHGPTPVKEGSKDPRGGFFDDVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 100 - protein, 307 aa, synthetic construct
MANQEIRYSEVTPYHVTSVWTKGVTPPANFTQGEDVFHAPYVANQGWYDITKTFNGGDDLLCGAATAGNMLHWWFDQNKEQIDRYLEEHPEKQKINFNGEQMFDVKEAIDTKNSQTDSKLFEYFKEKAFPYLSTKHLGVFPDLVLDMFINGYRLSLTNHGPTPVKEGSKDPRGGIFDAVFTRGDQSKLLTSRHDFKEKNLEEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 101 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKAKINFNGEQMFDVKEAIDTKNDQLDSKLFEYFKEKAFPYLSTKHLGVFPDLVLDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASIGMKRYFVGVNSAGKVAISAKEIKEDNIGAQVLGLFTLSTGQDSWNQTN

SEQ ID NO: 102 - protein, 307 aa, synthetic construct
MANQEIRYSEVTPYHVTSVWTKGVTPPANFTQGEDVFHAPYVANQGWYDINKTFNGGDDLLCGAATAGNMLHWWFDQNKDQIDRYLKEHPEKAKINFNGEQMFDVKEAIDTKNDQTNSKLFEYFKEKAFPYLSTKHLGVFPDLVLDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 103 - protein, 307 aa, synthetic construct
MANQEIRYSEVTPYHVTSVWTKGVTPPANFTQGEDVFHAPYKANQGWYDINKTFNGGDDLLCGAATAGNMLHWWFDQNKDYIDRYLEEHPEKQKINFNGEQMFDVKEAIDTKNNQTDSKLFEYFKEKAFPYLSTKHLGVFPDRVIDMFINGYRLSLTNHGPTPVKEGSKDPRGGFFDDVFTRGDQSKLLTSRHDFKEKNLKEISDLIKKELKEGKALGLSHTYANVRINHVINLWGADFDSNGNLKAIYVTDSDSNASVGMKKYRVGVNSAGKVAISAKEIKEDNIGAQVLGLFTLSTGQDSWNQTN

SEQ ID NO: 104 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDYIDRYLEEHPEKAKINFNGEQMFDVKEAIDTKNDQTDSKLFEYFKEKAFPYLSTKHLGVFPDHVIDMFINGYRLSLTNHGPTPVKEGSKDPRGGFFDDVFGRGDQSKLLTSRHDFKEKNLKEISDLIKKELTEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 105 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKEQIERYLKEHPEKGKINFNGEQMFDVKEAIDTKNNQTDSKLFEYFKEKAFPYLSTKHLGVFPDRVLDMFINGYRLSLTNHGPTPVKEGSKDPRGGFFDDVFGRGDQSKLLTSRHDFKEKNLEEISDLIKKELTEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 106 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKDYIDRYLKKHPEKAKINFNGEQMFDVKEAIDTKNDQLDSKLFEYFKEKAFPYLSTKHLGVFPDLVLDMFINGYRLSLTNHGPTPVKEGSKDPRGGFFDDVFTRGDQSKLLTSRHDFKEKNLEEISDLIKKELTEGKALGLSHTYANVRINHVINLWGADFDENGNLKAIYVTDSDSNASIGMKRYFVGVNSAGKVAISAKEIKEDNIGAQVLGLFTLSTGQDSWNQTN

SEQ ID NO: 107 - protein, 307 aa, synthetic construct
MANQEIRYSEVTPYHVTSVWTKGVTPPANFTQGEDVFHAPYVANQGWYDINKTFNGGDDLLCGAATAGNMLHWWFDQNKEYIDRYLKEHPEKQKINFNGEQMFDVKEAIDTKNSQTDSKLFEYFKEKAFPYLSTKHLGVFPDLVIDMFINGYRLSLTNHGPTPVKEGSKDPRGGFFDAVFTRGDQSKLLTSRHDFKEKNYNEISDLIKKELKEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 108 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKQKINFNGEQMFDVKEAIDTKNDQLDSKLFEYFKEKAFPYLSTKHLGVFPDLVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 109 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKQKINFNGEQMFDVKEAIDTKNHQLDSKLFEYFKEKAFPYLSTKHLGVFPDLVIDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 110 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKAKINFNGEQMFDVKEAIDTKNHQLDSKLFEYFKEKAFPYLSTKHLGVFPDLVIDMFINGYRLSLTNHGPTPVKEGSKDPRGGFFDAVFGRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 111 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKEYIDRYLEEHPEKQKINFNGEQMFDVKEAIDTKNHQLDSKLFEYFKEKAFPYLSTKHLGVFPDLVLDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 112 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKDYIDRYLEEHPEKQKINFNGEQMFDVKEAIDTKNHQLDSKLFEYFKEKAFPYLSTKHLGVFPDLVIDMFINGYRLSLTNHGPTPVKEGSKDPRGGFFDAVFGRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 113 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKEYIDRYLKEHPEKQKINFNGEQMFDVKEAIDTKNHQLDSKLFEYFKEKAFPYLSTKHLGVFPDLVLDMFINGYRLSLTNHGPTPVKEGSKDPRGGFFDDVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 114 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGFFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 115 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKAKINFNGEQMFDVKEAIDTKNHQLDSKLFEYFKEKAFPYLSTKHLGVFPDHVIDMFINGYRLSLTNHGPTPVKEGSKDPRGGIFDAVFGRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 116 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKEYIKRYLEEHPEKQKINFNGEQMFDVKEAIDTKNHQLDSKLFEYFKEKAFPYLSTKHLGVFPDHVLDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASVGMKKYFVGVNSAGKVAISAKEIKEDNIGAQVLGLFTLSTGQDSWNQTN

SEQ ID NO: 117 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFGRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 118 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKEQIKRYLKEHPEKQKINFNGEQMFDVKEAIDTKNHQLDSKLFEYFKEKAFPYLSTKHLGVFPDHVLDMFINGYRLSLTNHGPTPVKEGSKDPRGGIFDDVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 119 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIDRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 120 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDLVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 121 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDYIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 122 - protein, 307 aa, synthetic construct
MANQEIRYSEVTPYHVTSVWTKGVTPPANFTQGEDVFHAPYVANQGWYDINKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 123 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDDVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 124 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNDQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 125 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKEQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 126 - protein, 309 aa, synthetic construct
MANQEIRYSEVTPYHVTSVWTKGVTPPANFTQGEDVFHAPYVANQGWYDITKTFNGKDDLLCGAATAGNMLHWWFDQNKEEIEAYLKKHPEKQKIMFGDQELLDVRKVINTKGSQTNSELFNYFRDKAFPGLSARRLGVMPDLVLDMFINGYYLNVYKTQTTDVNRTYQEKDKRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 127 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEYIEAYLKKHPEKQKIMFGDQELLDVRKVINTKGDQTNSELFNYFRDKAFPYLSARRLGVMPDLVLDMFINGYYLNVTKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 128 - protein, 309 aa, synthetic construct
MANQEIRYSEVTPYHVTSVWTKGVTPPANFTQGEDVFHAPYVANQGWYDITKTFNGKDDLLCGAATAGNMLHWWFDQNKEKIEAYLKKHPEKQKIMFGDQELLDVRKVINTKDDQTNSELFNYFRDKAFPGLSARRLGVMPDLVLDMFINGYYLNVTKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 129 - protein, 309 aa, synthetic construct
MANQEIRYSEVTPSHVTSVWTKGVTPPANFTQGEDVFHAPYVANQGWYDITKTFNGKDNLLCGAATAGNMLHWWFDQNKEEIEAYLKKHPEKQKIMFGDQELLDVRKVINTKDSQTNSELFNYFRDKAFPGLSARRLGVMPDLVLDMFINGYYLNVYKTQTTDVNRTYQEKDRRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 130 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKDDQTNSELFNYFRDKAFPGLSARRLGVMPDLVLDMFINGYRLNVTKTQTTDVNETYQTKDKRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKDDNIGAQVLGLFTLSTGQDIWNQTN

SEQ ID NO: 131 - protein, 309 aa, synthetic construct
MANQEIRYSEVTPYHITSVWTKGVTPPAKFTQGEDVFHAPYVANQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTN

SEQ ID NO: 132 - protein, 309 aa, synthetic construct
MANQEIRYSEVTPYHVTSVWTKGVTPPTNFTQGEDVFHAPYVANQGWYDITKTFNGKDNLLCGAATAGNMLHWWFDQNKEEIERYLKKHPEKQKIMFGDQELLDVRKVINTKDDQKNSELFNYFRDKAFPGLSARRLGVMPDLVLDMFINGYYLNVGKTQTTDVNRTYQEKDKRGGIFDAVFTRGDQSKLLTSRHDFKEKNLKEISDLIKQELTEGKALGLSHTYANVRINHVINLWGADFDSNGNLEAIYVTDSDSNASIGMKKYFVGVNSAGKVAISAKEIEEDNIGAQVLGLFTLSTGQDIWNQTN

SEQ ID NO: 133 - protein, 309 aa, synthetic construct
MANQEIRYSEETPYHVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 134 - protein, 309 aa, synthetic construct
MANQEIRYSEVTPKTITSVWTKGVTPPAKFTQNEDVFHAPYVANQGWYDITKTFNGKDDLLCGAATAGNMLHWWFDQNKEQIEAYLKKHPEKQKIMFGDQELLDVRKVINTKDDQTNSELFNYFKDKAFPNLSARRLGVMPDLVLDMFINGYRLNVGKTQTTDVNRTYQDKDPRGGIFDAVFTRGDQSKLLTSRHDFKEKNLKEISDLIKQELTEGKALGLSHTYANVRINHVINLWGADFDSEGNLEAIYVTDSDSNASIGMKKYFVGVNSAGKVAISAKEIEEDNIGAQVLGLFTLSTGQDIWEQTN

SEQ ID NO: 135 - protein, 309 aa, synthetic construct
MANQEIRYSEVTPKHITSVWTKGVTPPTQFIQGEDVFHAPYKANQGWYDITKTFNGKDDLLCGAATAGNMLHWWFDQNKEEIEAYLKKHPEKQKIMFGDQELLDVRKAINTKDDQTNSELFNYFRDKAFPNLSARRLGVMPDHVLDMFINGYYLNVNKTQTTDVNRTYQEKDPRGGIFDAVFTRGDQSKLLTSRHDFKEKTLKEISDLIKQELTEGKALGLSHTYANVRINHVINLWGADFDSNGNLKAIYVTDSDSDASIGMKKYFVGVNSAGKVAISAKEIKGDNIGAQVLGLFTLSTGQDIWNQTN

SEQ ID NO: 136 - protein, 309 aa, synthetic construct
MANQEIRYSEVTPSHVTSVWTKGVTPPADFTQGEDVFHAPYVANQGWYDITKTFNGKDNLLCGAATAGNMLHWWFDQNKEQIENYLKKHPEKQKIMFGDQELLDVRKVINTKDSQTNSALFNYFRDKAFPNLSARRLGVMPDLVLDMFINGYYLNLTKTQTTDVNRTYQTKDKRGGIFDAVFTRGDQSKLLTSRHDFKEKTLKEISDLIKQELTEGKALGLSHTYANVRINHVINLWGADFDSNGNLKAIYVTDSDSNASIGMKKYFVGVNSAGKVAISAKEITEDNIGAQVLGLFTLSTGKDQWNQTN

SEQ ID NO: 137 - protein, 309 aa, synthetic construct
MANQEIRYSEVTPSTITSVWTKGVTPPAQFIQNEDVFHAPYVANQGWYDITKTFNGKDDLLCGAATAGNMLHWWFDQNKEEIEAYLKKHPEKQKIMFGDQELLDVRKVINTKDDQTNSALFNYFKDKAFPNLSARRLGVMPDLVLDMFINGYYLNVGKTQTTDVNRTYQNKDRRGGIFDAVFTRGDQSKLLTARHDFKEKNLNEISDLIKQELTEGKALALSHTYANVSINHVINLWGADFDANGNLEAIYVTDSDSNASIGMKKYFVGVNSAGKVAISAKEIEEDNIGAQVLGLFTLSTGQDIWNKTN

SEQ ID NO: 138 - protein, 309 aa, synthetic construct
MANQEIRYSEETPYHVTSVWTKGVTPPEKFTQGEDVFHAPYVANQGWYDITKTFNGKDDLLCGAATAGNMLHWWFDQNKDQIEAYLSKHPEKQKIMFGDQELLDVRKAINTKDSQTNSELFNYFRDKAFPNLSARRLGVMPDLVLDMFINGYRLNVTKTQTTDVNETYQEKDKRGGIFDAVFTRGDQSKLLTSRHDFKEKTLNEISDLIKKELTEGKALGISHTYANVRINHVINLWGADFNSEGNLEAIYVTDSDSNASIGMKKYFVGVNSAGKVAISAKEIEEENIGAQVLGLFTLSTGQDIWQQTN

SEQ ID NO: 139 - protein, 309 aa, synthetic construct
MANQEIRYSEETPYTVTSVWTKGVTPPTQFIQGEDVFHAPYKANQGWYDITKTFNGKDNLLCGAATAGNMLHWWFDQNKEYIEAYLKKHPEKQKIMFGDQELLDVRKVINTKDSQTDSKLFNYFKDKAFPNLSARRLGVMPDLVLDMFINGYYLNVGKTQTTDVNRTYQEKDKRGGIFDAVFTRGDQSKLLTSRHDFKEKSLKEISDLIKKELTEGKALGLSHTYANVRINHVINLWGADFDSEGNLKAIYVTDSDSDASIGMKKYFVGVNSSGKVAISAKEIEEDNIGAQVLGLFTLSSGQDIWNQTN

SEQ ID NO: 140 - protein, 309 aa, synthetic construct
MANQEIRYSEVTPKTITSVWTKGVTPPADFTQGEDVFHAPYKPNQGWYDINKTFNGKDNLLCGAATAGNMLHWWFDQNKEQIEAYLKKHPEKQKIMFGDQELLDVRKAINTKDDQTDSKLFNYFKDKAFPNLSARRLGVMPDHVLDMFINGYRLNVTKTQTTDVNRTYQTKDKRGGFFDAVFTRGDQSKLLTNRHDFKEKNLKEISDLIKKELTEGKALGLSHTYANVRINHVINLWGADFDSEGNLKAIYVTDSDSNASIGMKKYYVGVNSAGKVAISAKEIKGENIGAQVLGLYTLSTGQDIWNQTN

SEQ ID NO: 141 - protein, 309 aa, synthetic construct
MANQEIRYSEEDPKHVTSVWTKGVTPPTDFTQGEDVLHAPYIANQGWYDITKTFNGKDDLLCGAATAGNMLHWWFDQNKEEIENYLKKHPEKQKIMFGDQELLDVRKVINTKDSQTNSKLFNYFREKAFPNLSARRLGVMPDLVLDMFINGYYLNVTKTQTTDVNRTYQTKDKRGGIFDAVFTRGDQTKLLTNRHDFKEKTLNEISDLIKQELQEGKALGLSHTYANVRINHVINLWGADFDSNGNLEAIYVTDSDANASIGMKKYFVGKNSAGKVAISAKEIKDDNIGAQVLGLFTLSTGQDIWNQTN

SEQ ID NO: 142 - protein, 309 aa, synthetic construct
MANQEIRYSEVTPYHITSVWTKGVTPPEQFTQGEDVFHAPYIANQGWYDITKTFNGKDNLLCGAATAGNMLHWWFDQNKEEIERYLKKYPEKQKIMFGDQELLDVRKVINTKDSQTNSKLFEYFRDKAFPNLSARRLGVMPDLVLDMFINGYYLSVTKTQTTDVNRTYGNKDNRGGIFDAVFTRGDQSKLLTNRHDFKEKNLKEISQLIKQELQEGKALALSHTYANVRINHVINLWGADFDSEGNLKAIYVTDSDSNASIGMKKYFVGVNSSGKVAISAKEIEEDNIGAQVLGLFTLSTGQDIWEQTN

SEQ ID NO: 143 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKGDQTNSELFNYFRDKAFPGLSARRLGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 144 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKDDQTNSELFNYFRDKAFPGLSARRLGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 145 - protein, 309 aa, synthetic construct
MANQEIRYSEETPYHVTSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKDDQTNSELFNYFRDKAFPGLSARRLGVMPDLVLDMFINGYYLNVYKTQTTDVNRTYQEKDRRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 146 - protein, 309 aa, synthetic construct
MANQEIRYSEETPYHITSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKDDQTNSELFNYFRDKAFPNLSARRLGVMPDLVLDMFINGYYLNVGKTQTTDVNRTYQEKDKRGGIFDAVFTRGDQSKLLTSRHDFKEKNLKEISDLIKQELTEGKALGLSHTYANVRINHVINLWGADFDSNGNLKAIYVTDSDSNASIGMKKYFVGVNSAGKVAISAKEIEEDNIGAQVLGLFTLSTGQDIWNQTN

SEQ ID NO: 147 - protein, 309 aa, synthetic construct
MANQEIRYSEVTPYTITSVWTKGVTPPADFTQGEDVFHAPYVANQGWYDITKTFNGKDDLLCGAATAGNMLHWWFDQNKEKIEAYLKKHPEKQKIMFGDQELLDVRKAINTKDDQTNSELFNYFRDKAFPNLSARRLGVMPDLVLDMFINGYYLNVYKTQTTDVNRTYQEKDKRGGIFDAVFTRGDQSKLLTSRHDFKEKNLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTN

SEQ ID NO: 148 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKDDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 149 - protein, 309 aa, synthetic construct
MANQEIRYSEETPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKTLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 150 - protein, 309 aa, synthetic construct
MANQEIRYSEVTPYHITSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVGKTQTTDVNRTYQEKDKRGGIFDAVFTRGDQSKLLTSRHDFKEKNLKEISDLIKQELTEGKALGLSHTYANVRINHVINLWGADFDSNGNLKAIYVTDSDSNASIGMKKYFVGVNSAGKVAISAKEIEEDNIGAQVLGLFTLSTGQDSWNQTN

SEQ ID NO: 151 - protein, 309 aa, synthetic construct
MANQEIRYSEVTPYTVTSVWTKGVTPPADFTQGEDVFHAPYVANQGWYDITKTFNGKDDLLCGAATAGNMLHWWFDQNKEKIEAYLKKHPDKQKIMFGDQELLDVRKAINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSEGNLKAIYVTDSDSNASIGMKKYFVGVNSAGKVAISAKEIKEDNIGAQVLGLFTLSTGQDSWNQTN

SEQ ID NO: 152 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPEKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 153 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRLGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 154 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 155 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 156 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDKRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 157 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKQELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 158 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGSQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 159 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVTKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 160 - protein, 309 aa, synthetic construct
MANQEIRYSEVTPYHVTSVWTKGVTPPAKFTQGEDVFHAPYVANQGWYDITKTFNGKDDLLCGAATAGNMLHWWFDQNKEEIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 161 - protein, 312 aa, synthetic construct
MRNATEAYAKEVPHQITSVWTKGVTPLTPEQFRYNNEDVIHAPYLAHQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTLIKQELTEGRALALSHTYANVSISHVINLWGADFNAEGNLEAIYVTDSDANASIGMKKYFVGINASGKVAISAKKIEGENIGAQVLGLFTLSSGKDIWQKLS

SEQ ID NO: 162 - protein, 312 aa, synthetic construct
MRNATEAYAKEVPHQITSVWTKGVTPLTPEQFRYNNEDVIHAPYLANQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQTKDKRGGIFDAVFTRGDQTTLLTARHDLKNKGLNDISTIIKQELTEGKALALSHTYANVSISHVINLWGADFNAEGNLEAIYVTDSDANASIGMKKYFVGVNAAGHVAISAKKIEGENIGAQVLGLFTLSSGKDIWQKLS

SEQ ID NO: 163 - protein, 312 aa, synthetic construct
MRNATEAYAKEVPHQITSVWTKGVTPPTPEQFRYNNEDVIHAPYTAHQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTLIKQELTEGRALALSHTYANVSISHVINLWGADFNAEGNLEAIYVTDSDANASIGMKKYFVGINAAGHVAISAKKIEGENIGAQVLGLFTLSSGKDIWQKLS

SEQ ID NO: 164 - protein, 312 aa, synthetic construct
MRNATEAYAKEVPHTITSVWTKGVTPLTPEQFRYNNEDVIHAPYVAHQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTLIKQELTEGKALALSHTYANVSISHVINLWGADFNAEGNLEAIYVTDSDDNASIGMKKYFVGVNAAGKVAISAKKIEGENIGAQVLGLFTLSSGKDIWQKLS

SEQ ID NO: 165 - protein, 312 aa, synthetic construct
MRNATEAYAKEVPHQITSVWTKGVTPPTPEQFRYNNEDVFHAPYTAHQGWYDITKTFDGKDNLLCGAATAGNMLHWWFDQNKTEIEAYLSKHPEKQKIIFNNQELFDLKAAIDTKDSQTNSALFNYFRDKAFPNLSARQLGVMPDLVLDMFINGYYLNVFKTQSTDVNRPYQDKDKRGGIFDAVFTRGDQTTLLTARHDLKNKTLNDISTIIKQELTEGRALALSHTYANVSISHVINLWGADFNAEGNLEAIYVTDSDSNASIGMKKYFVGVNASGKVAISAKKIEGENIGAQVLGLFTLSSGKDIWQKLS

SEQ ID NO: 166 - protein, 312 aa, synthetic construct
MRNATEAYAKEVPHQITSVWTKGVTPPTPEQFRYNNEDVFHAPYLAHQGWYDITKTFNGKDNLLCGAATAGNMLHWWFDQNKTEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTNRHDLKNKGLNDISTLIKQELTEGKALALSHTYANVSISHVINLWGADFNAEGNLEAIYVTDSDANASIGMKKYFVGINSAGHVAISAKKIEGENIGAQVLGLFTLSSGKDIWQKLS

SEQ ID NO: 167 - protein, 312 aa, synthetic construct
MRNATEAYAKEVPHKITSVWTKGVTPLTPEQFRYNGEDVIHAPYLANQGWYDITKTFDGKDNLLCGAATAGNMLHWWFDQNKTEIEAYLKKHPEKQKIIFNNQELFDLKAAIDTKDSQTNSALFNYFKDKAFPNLSARQLGVMPDHVLDMFINGYYLNVFKTQSTDVNRPYQDKDKRGGIFDAVFTRGDQTKLLTARHDLKNKGLNEISTLIKQELTEGKALALSHTYANVSISHVINLWGADFNAEGNLEAIYVTDSDANASIGMKKYFVGVNASGKVAISAKKIEGENIGAQVLGLFTLSSGKDIWQKLS

SEQ ID NO: 168 - protein, 312 aa, synthetic construct
MRNATEAYAKEVPHTITSVWTKGVTPPTPEQFTYYNEDVFHAPYLAHQGWYDITKTFNGKDNLLCGAATAGNMLHWWFDQNKTEIEAYLSKHPEKQKIIFNNQELFDLKAAIDTKDSQTNSQLFNYFKDKAFPNLSARQLGVMPDLVLDMFINGYYLNVFKTQSTDVNRPYQDKDKRGGIFDAVFTRGDQTKLLTARHDLKNKGLNDISDLIKQELTEGKALALSHTYANVSINHVINLWGADFNAEGNLEAIYVTDSDANASIGMKKYFVGINASGKVAISAKKIEGENIGAQVLGLFTLSSGKDIWQKLS

SEQ ID NO: 169 - protein, 312 aa, synthetic construct
MRNATEAYNEETPHQITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFREKAFPNLSARQLGVMPDLVLDMFINGYYLNVTKTQSTDVNRPYQDKDKRGGIFDAVFTRGDQTKLLTARHDLKNKTLNEISTLIKQELTEGRALALSHTYANVSISHVINLWGADFNAEGNLEAIYVTDSDANASIGMKKYFVGVNAAGHVAISAKKIEGENIGAQVLGLFTLSSGKDIWQKLS

SEQ ID NO: 170 - protein, 312 aa, synthetic construct
MRNATEAYAKETPKTITSVWTKGVTPPTPEQFRYNGEDVIHAPYLAHQGWYDITKTFDGKDNLLCGAATAGNMLHWWFDQNKTEIERYLKKHPEKQKIIFNNQELFDLKAAIDTKDSQTNSALFNYFRDKAFPNLSARQLGVMPDLVLDMFINGYYLNVTKTQSTDVNRPYQTKDKRGGIFDAVFTRGDQTKLLTARHDLKNKTLNDISTLIKQELTEGKALALSHTYANVSISHVINLWGADFNAEGNLEAIYVTDSDSNASIGMKKYFVGVNAAGKVAISAKKIKGENIGAQVLGLFTLSSGKDIWQKLS

SEQ ID NO: 171 - protein, 312 aa, synthetic construct
MRNATEAYNKATPTTITSVWTKGVTPPTPEQFRYNNEDVFHAPYKAHQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTKLLTARHDLKDKGLNEISDLIKQELTEGKALALSHTYANVRISHVINLWGADFNAEGNLEAIYVTDSDANASIGMKKYFVGVNSSGHVAISAKKIEGENIGAQVLGLFTLSSGKDIWQKLS

SEQ ID NO: 172 - protein, 312 aa, synthetic construct
MRNATEAYAKEVPHTITSVWTKGVTPPTPEQFTYQNEDVFHAPYLANQGWYDITKTFNGKDNLLCGAATAGNMLHWWFDQNKEEIERYLSKHPEKQKIIFNNQELFDLKAAIDTKDSQTNSALFNYFRDKAFPNLSARQLGVMPDLVLDMFINGYYLNVFKTQSTDVNRPYQDKDKRGGIFDAVFTRGDQTTLLTARHDLKNKGLNDISDLIKQELTEGKALALSHTYANVSISHVINLWGADFNAEGNLEAIYVTDSDANASIGMKKYFVGVNTAGKVAISAKKIEGENIGAQVLGLFTLSSGKDIWEQLS

SEQ ID NO: 173 - protein, 312 aa, synthetic construct
MRNATEAYNKETPKTITSVWTKGVTPPTPEQFTKQNEDVFHAPYVANQGWYDITKTFNGKDNLLCGAATAGNMLHWWFDQNKTEIENYLKKHPEKQKIIFNNQELFDLKAAIDTKDSQTNSALFNYFRDKAFPNLSARQLGVMPDHVLDMFINGYYLNVNKTQSTDVNRPYDDKDKRGGIFDAVFTRGDQTTLLTARHDLKNKGLNEISTLIKQELTEGRALALSHTYANVSISHVINLWGADFNAEGNLEAIYVTDSDANASIGMKKYFVGKNASGKVAISAKKIEGDNIGAQVLGLFTLSSGKDIWQKLS

SEQ ID NO: 174 - protein, 312 aa, synthetic construct
MRNATEAYAKETPKQITSVWTKGVTPPTPEQFRYNNEDVFHAPYVANQGWYDITKTFDGKDNLLCGAATAGNMLHWWFDQNKTEIEKYLSKHPEKQKIIFNNQELFDLKAAIDTKDSQTNSQLFNYFRDKAFPNLSARQLGVMPDLVLDMFINGYYLNVTKTQSTDVNRPYQDKDKRGGIFDAVFTRGDQTKLLTARHDLGNKSLNEISQLIKQELQEGKALALSHTYANVRISHVINLWGADFDAEGNLEAIYVTDSDSNASIGMKKYYVGVNSAGKVAISAKKIEGENIGAQVLGLFTLSSGKDIWQKLS

SEQ ID NO: 175 - protein, 312 aa, synthetic construct
MRNATEAYNEETPKQITSVWTKGVTPLTPEDFRYNNEDVFHAPYLANQGWYDITKTFNGKDNLLCGAATAGNMLHWWFDQNKEEIEAYLKKHPEKQKIIFNNQELFDLKAAIDTKDSQTNSQLFNYFKDKAFPNLSARQLGVMPDLVLDMFINGYYLNVNKTQSTDVNRPYQDKDKRGGIFDAVFTRGDQTKLLTERHDLKNKGLNDISTLIKQELTEGKALALSHTYANVSINHVINLWGADFDAEGNLEAIYVTDSDSNESIGMKKYFVGINAAGKVAISAKKIEDENIGAQVLGLFTLSSGKDIWQQLS

SEQ ID NO: 176 - protein, 312 aa, synthetic construct
MRNATEAYNEDTPKQITSVWTKGVTPPTPEQFRKYNEDVLHAPYIANQGWYDITKTFNGKDDLLCGAATAGNMLHWWFDQNKTEIEAYLSKYPEKQKIIFNNQELFDLRAAIDTKDSQTNSALFNYFRDKAFPNLSARQLGVMPDLVLDMFINGYYLNVTKTQSTDVNRPYQTKDKRGGIFDAVFTRGDQTTLLTSRHDLKNKTLNEISDLIKQELTEGKALALSHTYANVSISHVINLWGADFNAEGNLEAIYVTDSDANASIGMKKYFVGVNAAGKVAISAKKIEGENIGAQVLGLFTLSTGKDIWEKLS

SEQ ID NO: 177 - protein, 312 aa, synthetic construct
MRNATEAYAKEVPKKITSVWTKGVTPLTPEQFIYQNEDVFHAPYLAHQGWYDITKTFNGKDNLLCGAATAGNMLHWWFDQNKEEIERYLSKHPEKQKIIFNNQELFDLKAAIDTKDSQTNSALFNYFRDKAFPNLSARQLGVMPDLVLDMFINGYYLNVTKTQSTDVNRPYQTKDKRGGIFDAVFTRGDQTKLLTERHDLKNKTLEEISQLIKQELTEGKALGLSHTYANVRISHVINLWGADFDAEGNLEAIYVTDSDSNASIGMKKYFVGVNASGKVAISAKKIEDDNIGAQVLGLFTLSSGKDIWEKLS

SEQ ID NO: 178 - protein, 312 aa, synthetic construct
MRNATEAYNKESPHTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 179 - protein, 312 aa, synthetic construct
MRNATEAYAKEVPHQITSVWTKGVTPLTPEQFRYNNEDVIHAPYLAHQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGVNAHGKVAISAKKIEGENIGAQVLGLFTLSSGKDIWQKLS

SEQ ID NO: 180 - protein, 312 aa, synthetic construct
MRNATEAYAKEVPHQITSVWTKGVTPLTPEQFRYNNEDVFHAPYLANQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTKLLTARHDLKNKGLNDISTLIKQELTEGKALALSHTYANVSISHVINLWGADFNAEGNLEAIYVTDSDANASIGMKKYFVGVNAHGHVAISAKKIEGENIGAQVLGLFTLSSGKDIWQKLS

SEQ ID NO: 181 - protein, 312 aa, synthetic construct
MRNATEAYAKEVPHQITSVWTKGVTPLTPEQFRYNNEDVIHAPYLANQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISDLIKQELTEGKALALSHTYANVSISHVINLWGADFNAEGNLEAIYVTDSDSNASIGMKKYFVGVNAAGHVAISAKKIEGENIGAQVLGLFTLSSGKDIWQKLS

SEQ ID NO: 182 - protein, 312 aa, synthetic construct
MRNATEAYAKEVPHQITSVWTKGVTPLTPEQFRYNNEDVIHAPYLANQGWYDITKTFNGKDNLLCGAATAGNMLHWWFDQNKTEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTLIKQELTEGKALALSHTYANVSISHVINLWGADFNAEGNLEAIYVTDSDSNASIGMKKYFVGVNAHGKVAISAKKIEGENIGAQVLGLFTLSSGKDIWQKLS

SEQ ID NO: 183 - protein, 312 aa, synthetic construct
MRNATEAYAKEVPKQITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLNDISTLIKQELTEGKALALSHTYANVSISHVINLWGADFNAEGNLEAIYVTDSDANASIGMKKYFVGVNAHGKVAISAKKIEGENIGAQVLGLFTLSSGKDIWQKLS

SEQ ID NO: 184 - protein, 312 aa, synthetic construct
MRNATEAYAKEVPHQITSVWTKGVTPLTPEQFRYNNEDVFHAPYLANQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTKLLTARHDLKNKGLNDISTLIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 185 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISDIIKQELTEGRALALSHTYANVSISHVINLWGADFNAEGNLEAIYVTDSDSNASIGMKKYFVGINAAGHVAISAKKIEGENIGAQVLGLFTLSSGKDIWQKLS

SEQ ID NO: 186 - protein, 312 aa, synthetic construct
MRNATEAYAKEVPHQITSVWTKGVTPLTPEQFRYNNEDVIHAPYLAHQGWYDITKAFNGKDNLLCGAATAGNMLHWWFDQNKTEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTIIKQELTEGRALALSHTYANVSISHVINLWGADFNAEGNLEAIYVTDSDANASIGMKKYFVGINAHGKVAISAKKIEGENIGAQVLGLFTLSSGKDIWQKLS

SEQ ID NO: 187 - protein, 312 aa, synthetic construct
MRNATEAYAKEVPKQITSVWTKGVTPPTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 188 - protein, 312 aa, synthetic construct
MRNATEAYAKEVPHQITSVWTKGVTPLTPEQFRYNNEDVIHAPYLAHQGWYDITKTFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 189 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTLIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 190 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 191 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGVNAHGHVAISAKKIEGENIGAQVLGLFTLSSGKDIWQKLS

SEQ ID NO: 192 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGKVAISAKKIEGENIGAQVLGLFTLSSGKDIWQKLS

SEQ ID NO: 193 - protein, 312 aa, synthetic construct
MRNATEAYAKEVPHQITSVWTKGVTPPTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 194 - protein, 312 aa, synthetic construct
MRNATEAYAKEVPHQITSVWTKGVTPLTPEQFRYNNEDVIHAPYLANQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 195 - protein, 312 aa, synthetic construct
MRNATEAYAKEVPHQITSVWTKGVTPLTPEQFRYNNEDVIHAPYLAHQGWYDITKAFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 196 - protein, 312 aa, synthetic construct
MRNATEAYAKEVPHQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAAGHVAISAKKIEGENIGAQVLGLFTLSSGKDIWQKLS

SEQ ID NO: 197 - protein, 312 aa, synthetic construct
MRNATEAYAKEVPHQITSVWTKGVTPLTPEQFRYNNEDVFHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 198 - protein, 307 aa, synthetic construct
MANQEIRYSEVTPYHITSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQDSWNQTN

SEQ ID NO: 199 - protein, 307 aa, synthetic construct
MANQEIRYSEVTPYHITSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLNDISQLIKQELQSGKALGLSHTYANVRINHVINLWGADFDAEGNLEAIYVTDSDSNASIGMKKYFVGKNSAGKVAISAKEIKEDNIGAQVLGLFTLSTGQDSWNQTN

SEQ ID NO: 200 - protein, 307 aa, synthetic construct
MANQEIRYSEVTPYHITSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLNTISQLIKQELQSGKALGLSHTYANVRINHVINLWGADFDAEGNLEAIYVTDSDSNASIGMKKYFVGKNSAGKVAISAKEIKEDNIGAQVLGLFTLSTGQDSWNQTN

SEQ ID NO: 201 - protein, 307 aa, synthetic construct
MANQEIRYSEVTPYHIKTVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLNDISQLIKQELQSGKALGLSHTYANVRINHVINLWGADFDAEGNLEAIYVTDSDSNASIGMKKYFVGKNSAGKVAISAKEIKEDNIGAQVLGLFTLSTGQDSWNQTN

SEQ ID NO: 202 - protein, 307 aa, synthetic construct
MANQEIRYSEVTPYHIKIVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKTLNDISQLIKQELQSGKALGLSHTYANVRINHVINLWGADFDAEGNLEAIYVTDSDSNASIGMKKYFVGKNSAGKVAISAKEIKEDNIGAQVLGLFTLSTGQDSWNQTN

SEQ ID NO: 203 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKRQSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNKTN

SEQ ID NO: 204 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKRQTKDPRGGIFDAVFGRGDQTKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQKSWNKTN

SEQ ID NO: 205 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKRQEKDPRGGIFDAVFGRGDQTKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQKSWNKTN

SEQ ID NO: 206 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPDKQKINFNGEQMFDVKEAIDTKNHQLDSKLFEYFKEKAFPYLSTKHLGVFPDHVIDMFINGYRLSLTNHGPTPVKRQTKDPRGGIFDAVFGRGDSTKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQKSWNKTN

SEQ ID NO: 207 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKTQIERYLKKHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGKDSWEKTN

SEQ ID NO: 208 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKTQIERYLKKHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGKDSWKKTN

SEQ ID NO: 209 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKTQIEAYLKKHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGKKSWEKTN

SEQ ID NO: 210 - protein, 307 aa, synthetic construct
MANQEIRYSEVTPYHVTSVWTDGVTPPANFTQGEDVFHAPYVANQGWYDITKTFNGKDDLLCGAATAGNMLHWWFDQNSTQIEAYLKKHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGKKSWEKTN

SEQ ID NO: 211 - protein, 307 aa, synthetic construct
MANQEIRYSEVTPYHVTSVWTKGVTPPTDFTQGEDVFHAPYKANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 212 - protein, 307 aa, synthetic construct
MANQEIRYSEVTPYHVTSVWTKGVTPPEDFTQGEDVFHAPYKANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 213 - protein, 307 aa, synthetic construct
MANQEIRYSEVTPYHVTSVWTKGVTPPTDFIKGEDVFHAPYKAHQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELQEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 214 - protein, 307 aa, synthetic construct
MANQEIRYSEVTPYHVTSVWTKGVTPPTDFIKGEDVFHAPYKAGQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELQEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 215 - protein, 307 aa, synthetic construct
MANQEIRYSEVTPYHVTTVWTDGVKPPTDFIKGEDVFHAPYKAHQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELQEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 216 - protein, 307 aa, synthetic construct
MANQEIRYSEVTPYHVTIVWTDGVKPPTDFIKGEDVFHAPYKAHQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELQEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 217 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNSQTNSELFNYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 218 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNDQTNSELFNYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 219 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNSQENSELFNYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 220 - protein, 307 aa, synthetic construct
MANQEIRYSEVTPYHVTSVWTKGVTPPANFTQGEDVFHAPYVANQGWYDITKTFNGGDDLLCGAATAGNMLHWWFDQNKDQIKRYLEEHPEKQKINFNGEQMFDVKEAIDTKNSQTNSELFNYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 221 - protein, 307 aa, synthetic construct
MANQEIRYSEVTPYHVTSVWTKGVTPPANFTQGEDVFHAPYVANQGWYDITKAFDGGDDLLCGAATAGNMLHWWFDQNKDQIKRYLEEHPEKQKINFNGEQMFDVKEAIDTKNSQTNSELFNYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 222 - protein, 307 aa, synthetic construct
MANQEIRYSEVTPYHVTSVWTKGVTPPTDFTQGEDVFHAPYKANQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 223 - protein, 307 aa, synthetic construct
MANQEIRYSEVTPYHVTSVWTKGVTPPEDFTQGEDVFHAPYKANQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 224 - protein, 307 aa, synthetic construct
MANQEIRYSEVTPYHVTSVWTKGVTPPTDFTQGEDVFHAPYKANQGWYDITKTFNGKDDLLCGAATAGNMLHWWFDQNKDQIKRYLEEHPEKQKINFNGEQMFDVKEAIDTKNDQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 225 - protein, 307 aa, synthetic construct
MANQEIRYSEVTPYHVTSVWTKGVTPPTDFIKGEDVFHAPYKAHQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 226 - protein, 307 aa, synthetic construct
MANQEIRYSEVTPYHVTSVWTKGVTPPTDFIKGEDVFHAPYKAGQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 227 - protein, 307 aa, synthetic construct
MANQEIRYSEVTPYHVTSVWTKGVKPPTDFIKGEDVFHAPYKAHQGWYDITKTFNGKDDLLCGAATAGNMLHWWFDQNKDQIKRYLEEHPEKQKINFNGEQMFDVKEAIDTKNSQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 228 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGKNASGKVAISAKEIEGENIGAQVLGLFTLSTGQDSWNQTN

SEQ ID NO: 229 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGKNASGKVAISAKEIEDENIGAQVLGLFTLSTGQDSWNQTN

SEQ ID NO: 230 - protein, 307 aa, synthetic construct
MANQEIRYSEVTPYHITSVWTKGVTPPTDFTQGEDVFHAPYKANQGWYDITKTFNGKDDLLCGAATAGNMLHWWFDQNKTQIERYLKKHPEKQKINFNGEQMFDVKEAIDTKNSQTNSELFNYFKEKAFPYLSTKHLGVFPDHVIDMFINGYRLSLTNHGPTPVKRQSKDPRGGIFDAVFTRGDQSKLLTSRHDFKEKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGKDSWEKTN

SEQ ID NO: 231 - protein, 307 aa, synthetic construct
MANQEIRYSEVTPYHITSVWTKGVTPPTDFIKGEDVFHAPYKAHQGWYDITKTFNGGDDLLCGAATAGNMLHWWFDQNKTQIEAYLKKHPEKQKINFNGEQMFDVKEAIDTKNSQTNSELFNYFKEKAFPYLSTKHLGVFPDHVIDMFINGYRLSLTNHGPTPVKRQTKDPRGGIFDAVFGRGDQTKLLTSRHDFKEKTLNDISQLIKQELQSGKALGLSHTYANVRINHVINLWGADFDAEGNLEAIYVTDSDSNASIGMKKYFVGKNASGKVAISAKEIEDENIGAQVLGLFTLSTGKKSWEKTN

SEQ ID NO: 232 - protein, 307 aa, synthetic construct
MANQEIRYSEVTPYHIKTVWTDGVKPPTDFIKGEDVFHAPYKAHQGWYDITKAFDGGDDLLCGAATAGNMLHWWFDQNSTQIEAYLKKHPDKQKINFNGEQMFDVKEAIDTKNSQTNSELFNYFKEKAFPYLSTKHLGVFPDHVIDMFINGYRLSLTNHGPTPVKRQTKDPRGGIFDAVFGRGDSTKLLTSRHDFKEKTLNDISQLIKQELQSGKALGLSHTYANVRINHVINLWGADFDAEGNLEAIYVTDSDSNASIGMKKYFVGKNASGKVAISAKEIEDENIGAQVLGLFTLSTGKKSWEKTN

SEQ ID NO: 233 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKIIFNNQELFDLKAAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 234 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSARQLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 235 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNTQSTDVNEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 236 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDLKNKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 237 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKKIKEDNIGAQVLGLFTLSTGQDSWNQTN

SEQ ID NO: 238 - protein, 307 aa, synthetic construct
MRNATEAYAKEVPHQVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 239 - protein, 307 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWQKLS

SEQ ID NO: 240 - protein, 316 aa, synthetic construct
MANQEIRYSEVTPYHVTSVWTKGVTPPANFRQGEDVFAAPYVANQGWYDITKTFNGKDDLLCGAATAGNMLHWWFDQNKDQIKRYLEEHPEKQKINFNGEQMFDVKELNTYESDHGYRDKSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDDKKLTIGDERIGMKKYFVGVNSAGKVAISAKEIKEDNIGAQVLGLFTLSTGQDSWNQTN

SEQ ID NO: 241 - protein, 311 aa, synthetic construct
MANQEIRYSEVTPYHVTSVWTKGVTPPANFRKIVDGNIAYYHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 242 - protein, 309 aa, synthetic construct
MANQEIRYSEVTPYHVTSVWTKGVTPPADFTYGEDVFHAPYVANQGWYDITKTFNGKDDLLCGAATAGNMLHWWFDQNKEQIEKYLKKHPEKQKIMFGDQELLDVRKVINTKGSQTNSELFNYFRDKAFPGLSARRLGVMPDLVLDMFINGYYLNVYKTQTTDVNRTYQEKDKRGGIFDAVFTRGDQSKLLTSRHDFKEKNLKEISDLIKQELTEGKALGLSHTYANVRINHVINLWGADFDSNGNLKAIYVTDSDSNASIGMKKYFVGVNSAGKVAISAKEIKEDNIGAQVLGLFTLSTGQDIWNQTN

SEQ ID NO: 243 - protein, 320 aa, synthetic construct
MANQEIRYSEVTPYHVTSVWTKGVTPPANFRKIVDGNIAYYAAPYVANQGWYDITKTFNGKDDLLCGAATAGNMLHWWFDQNKDQIKRYLEEHPEKQKINFNGEQMFDVKELNTYESDHGYRDKSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDDKKLTIGDERIGMKKYFVGVNSAGKVAISAKEIKEDNIGAQVLGLFTLSTGQDSWNQTN

SEQ ID NO: 244 - protein, 311 aa, synthetic construct
MANQEIRYSEVTPYHVTSVWTKGVTPPDHDFANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 245 - protein, 311 aa, synthetic construct
MANQEIRYSEVTPYHVTSVWTKGVTPPDHDFRKIVDGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 246 - protein, 309 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRHSINHVINLWGADFDSNGNLKAIYVTDSDSNASIGMKKYFVGVNSAGKVAISAKEIKEDNIGAQVLGLFTLSTGQDSWNQTN

SEQ ID NO: 247 - protein, 313 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDDKKLTISNASIGMKKYFVGVNSAGKVAISAKEIKEDNIGAQVLGLFTLSTGQDSWNQTN

SEQ ID NO: 248 - protein, 313 aa, synthetic construct
MANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDDKKLTIGDERIGMKKYFVGVNSAGKVAISAKEIKEDNIGAQVLGLFTLSTGQDSWNQTN

SEQ ID NO: 249 - protein, 319 aa, synthetic construct
MANQEIRYSEVTPYHVTSVWTKGVTPPDHDFANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRHSINHVINLWGADFDSNGNLKAIYVTDSDDKKLTISNASIGMKKYFVGVNSAGKVAISAKEIKEDNIGAQVLGLFTLSTGQDSWNQTN

SEQ ID NO: 250 - protein, 319 aa, synthetic construct
MANQEIRYSEVTPYHVTSVWTKGVTPPDHDFRKIVDGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRHSINHVINLWGADFDSNGNLKAIYVTDSDDKKLTIGDERIGMKKYFVGVNSAGKVAISAKEIKEDNIGAQVLGLFTLSTGQDSWNQTN

SEQ ID NO: 251 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 252 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSDLLSEALYTGKAIGLSYGPAGLRHSLGHIISVWGADLDADGNVVAIYVTDSDDKKLTIGDERVGLKRYKISTDDENRARLTAYEETDNTGGQIRGLYTLDTGKQAWADYFDKTEQTGTDQAEQLEHHHHHH

SEQ ID NO: 253 - protein, 361 aa, synthetic construct
MEVVEVWPYGQNPNGKTEILSQTEDSESLQRLRDIEDFQAEKKKQGVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSDLLSEALYTGKAIGLSYGPAGLRHSLGHIISVWGADLDADGNVVAIYVTDSDDKKLTIGDERVGLKRYKISTDDENRLRLTAYEETHNTGGQIRGLYTLDTGKQAWADYFDKTEQTGTDQAEQLEHHHHHH

SEQ ID NO: 254 - protein, 361 aa, synthetic construct
MEVVEVWPYGQNPNGKTEILSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQLEHHHHHH

SEQ ID NO: 255 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSDLLSEALYTGKAIGLSYGPAGLRHSLGHIISVWGADLDADGNVVAIYVTDSDDKKLTIGDERVGLKRYKISTDDENRARLTAYEETDNTGGQIRGLWTLDTGKQAWADYFDKTEQTGTDQAEQLEHHHHHH

SEQ ID NO: 256 - protein, 361 aa, synthetic construct
MEVVEVWPYGQNPNGKTEILSQTEDSESLQRLRDIEDFQAEKKKQNVVYTKWLDGVDVKDHDFRKIKDGNIEYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRARLTAYEETHNTGGQIRGLYTLDTGKQAWADYFDKTEQTGTDQAEQLEHHHHHH

SEQ ID NO: 257 - protein, 361 aa, synthetic construct
MEVVEVWPYGQNPNGKTEILSQTEDSESLQRLRDIEDFQAEKKKQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDYGYRDKSKLFDFISNNFNGPVWTDKLLDNYINGYAYNYKYGRTIEDPTKNTSKINFFKKVFNEKILTNIHSIRNQNEFSDLLSEALYTGKAIGLSYGPAGLRHSLGHIISVWGADLDADGNVVAIYVTDSDDKKLTIGDERVGLKRYKISTDDEGRLRLTAYEETDNTGGEIRGLYTLDTGKQAWADYFDKTEQTGTDQAEQLEHHHHHH

SEQ ID NO: 258 - protein, 361 aa, synthetic construct
MEVVEVWPYGQNPNGKTEILSQTEDSESLQRLRDIEDFQAEKKKQNVVYTKWLDGVDVKDHDFRKIKDGNIEYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRARLTAYEETHNTGGQIRGLWTLDTGKQAWADYFDKTEQTGTDQAEQLEHHHHHH

SEQ ID NO: 259 - protein, 361 aa, synthetic construct
MEVVEVWPYGQNPNGKTEILSQTEDSESLQRLRDIEDFQAEKKMQNVVYTKWLDGVTVKDHDFRKIVDGNIAYYATPLLNGRGFYDINKDFNRDSDKCAAAVAANMFHYWLDRNRDNVDRFLSQNPEKHGIIELPDGQLKLSDFLNTYESDNGYRDKSKLFDFISNNFNGPVWTDKLLDNYINGYAYNYKYGRTIEDPTKNTSKINFFKEVFNEKILTNIHSIRNQNEFSDLLSEALYTGKAIGLSYGPAGLRHSLGHIISVWGADLDADGNVVAIYVTDSDDKKLTIGDERVGLKRYKISTDDEGRARLTAYEETDNTGGQIRGLETLDTGKYAWADYFDKTEQTGTDQAEQLEHHHHHH

SEQ ID NO: 260 - protein, 361 aa, synthetic construct
MEVVEVWPYGQNPNGKTEILSQTEDSESLQRLRDIEDFQAEKKKEGVVYTKWLDGVDVDDHDFRKIVDGNIAYYATPLLNGRGFYDINKDFNRDSDKCAAAVAANMFHYWLDRNRDNVDRFLKQNPEKHGIIELPDGQLKLSDFLNTYESDNGYRDKSKLFDFISNNFNGPVWTDKLLDNYINGYAYNYKYGRTIEDPTKNTSKINFFKEVFNEKILTNNHSIRNYNTFSDLLSEALYTGKAIGLSYGPAGLRHSLGHIISVWGADLDADGNVVAIYVTDSDDKKLTIGDERVGLKRYKVSSDDENRLRLTAYEETHNTGGQIRGIYTLDTGKQAWADYFDKTEQTGTDQAEQLEHHHHHH

SEQ ID NO: 261 - protein, 361 aa, synthetic construct
MEVVEVWPYGQNPNGKTEILSQTEDSESLQRLRDIEDFQAEKKKENVVYTKWLDGVTVKDHDFRKIVDGNIAYYATPLLNGRGFYDINKDFNRDSDKCAAAVAANMFHYWLDINRDNVDRFLRQNPEKHGIIELPDGQLKLSDFLNTYESDDGYRDKSKLFDFISNNFNGPVWTDKLLDNYINGYGYNYKYGRTIEDPTKNTSKINFFKEVFNEKILTDNHSIRDQNEFSDLLSEALYTGKAIGLSYGPAGLRHSLGHIISVWGADLDADGNVVAIYVTDSDDKKLTIGDERVGLKRYKISYDDEGRARLTAYEEKDNTGGQIRGLYTLDTGKQAWADYFDKTEQTGTDQAEQLEHHHHHH

SEQ ID NO: 262 - protein, 361 aa, synthetic construct
MEVVEVWPYGQNPNGKTEILSQTEDSESLQRLRDIEDFQAEKKKEGVVYTKWLDGVDVDDHDFRKIVDGNIAYYATPLLNGRGFYDINKDFNRDSDKCAAAVAANMFHYWLDRNRDNVDRFLKQNPEKHGIIELPDGQLKLSDFLNTYESDNGYRDKSKLFDFISNNFNGPVWTDKLLDNYINGYAYNYKYGRTIEDPTKNTSKINFFKEVFNEKILTNNHSIRNYNTFSDLLSEALYTGKAIGLSYGPAGLRHSLGHIISVWGADLDADGNVVAIYVTDSDDKKLTIGDERVGLKRYKVSSDDENRLRLTAYEETHNTGGQIRGIWTLDTGKQAWADYFDKTEQTGTDQAEQLEHHHHHH

SEQ ID NO: 263 - protein, 361 aa, synthetic construct
MEVVEVWPYGQNPNGKTEILSQTEDSESLQRLRDIEDFQAEKKKENVVYTKWLDGVTVKDHDFRKIVDGNIAYYATPLLNGRGFYDINKDFNRDSDKCAAAVAANMFHYWLDINRDNVDRFLRQNPEKHGIIELPDGQLKLSDFLNTYESDDGYRDKSKLFDFISNNFNGPVWTDKLLDNYINGYGYNYKYGRTIEDPTKNTSKINFFKEVFNEKILTDNHSIRDQNEFSDLLSEALYTGKAIGLSYGPAGLRHSLGHIISVWGADLDADGNVVAIYVTDSDDKKLTIGDERVGLKRYKISYDDEGRARLTAYEEKDNTGGQIRGLWTLDTGKQAWADYFDKTEQTGTDQAEQLEHHHHHH

SEQ ID NO: 264 - protein, 361 aa, synthetic construct
MEVVEVWPYGQNPNGKTEILSQTEDSESLQRLRDIEDFQAEKKKQGVVYTKWLDGVDVDDHDFRKIVDGNIAYYATPLLNGKGFYDINKDFNRDSDKCAAAVAANMFHYWLDQNRDNVDRFLRQNPEKHGIIELPDGQLKLSDFLNTYESDNGYRDKSKLFDFISNNFNGPVWTDKLLDNYINGYAYNYKYGRTIEDPTKNTSKINFFKDVFNEKILTNIHSIRNYNTFSNLLSEALYTGKAIGLSYGPAGLRHSLGHIISVWGADLDEDGNVVAIYVTDSDDKKLTIGDERVGLKRYKISTDDEGRARLTAYEENDNTGGEIRGLYTLDTGKQAWADYFDKTEQTGTDQAEQLEHHHHHH

SEQ ID NO: 265 - protein, 361 aa, synthetic construct
MEVVEVWPYGQNPNGKTEILSQTEDSESLQRLRDIEDFQAEKKKQNVVYTKWLDGVTVDDHDFRKITDGNTAYYATPLLNGRGFYDINKDFNRDSDKCAAAVAANMFHYWLDQNRDNVDRFLKQNPEKHGIIELPDGQLKLSDFLNTYESDDGYRDKSKLFDFISNNFNGPVWTDKLLDNYINGYAYNYKYGRTIEDPTKNTSKINFFKEVFNEKLLTNNHSIRNQNEFSDLLSEALYTGKAIGLSYGPAGLRHSLGHIISVWGADFDADGNVVAIYVTDSDDKKLTIGDERVGLKRYKISSDDEGRARLTAYTEKHNTGGQIRGLYTLDTGKQEWADYFDKTEQTGTDQAEQLEHHHHHH

SEQ ID NO: 266 - protein, 361 aa, synthetic construct
MEVVEVWPYGQNPNGKTEILSQTEDSESLQRLRDIEDFQAEKKKQGVVYTKWLDGVDVDDHDFRKIVDGNIAYYATPLLNGKGFYDINKDFNRDSDKCAAAVAANMFHYWLDQNRDNVDRFLRQNPEKHGIIELPDGQLKLSDFLNTYESDNGYRDKSKLFDFISNNFNGPVWTDKLLDNYINGYAYNYKYGRTIEDPTKNTSKINFFKDVFNEKILTNIHSIRNYNTFSNLLSEALYTGKAIGLSYGPAGLRHSLGHIISVWGADLDEDGNVVAIYVTDSDDKKLTIGDERVGLKRYKISTDDEGRARLTAYEENDNTGGEIRGLWTLDTGKQAWADYFDKTEQTGTDQAEQLEHHHHHH

SEQ ID NO: 267 - protein, 361 aa, synthetic construct
MEVVEVWPYGQNPNGKTEILSQTEDSESLQRLRDIEDFQAEKKKEGVVYTKWLDGVDVKDHDFRKIVDGNIEYYATPLLNGRGFYDINKDFNQDSDKCAAAVAANMFHYWLDRNRDNVDRFLSQNPEKHGIIELPDGQLKLSDFLNTYESDDGYRDKSKLFDLISNNFNGPVWTDKLLDNYINGYAYNYKYGRTIEDPTKNTSKINFFKEVFNEKILTNIHSIRNQNEFSDKLSEALYTGKAIGLSYGPAGLRHSLGHIISVWGADLDEDGNVVAIYVTDSDDKKLTIGDERVGLKRYKVSTDDEGRLRLTAYEETDNTGGEIRGIWTLDTGKQAWADYFDKTEQTGTDQAEQLEHHHHHH

SEQ ID NO: 268 - protein, 361 aa, synthetic construct
MEVVEVWPYGQNPNGKTEILSQTEDSESLQRLRDIEDFQAEKKKEGVVYTKWLDGVTVKDHDFRKIVDGNIEYYATPLLNGRGWYDINKDFNRDSDKCAAAVAANMFHYWLDRNRDNVDRFLKQNPEKHGIIELPDGQLKLSDFLNTYESDNGYRDKSKLFDFISKNFNGPVWTDKLLDNYINGYGYNYKYGRTIEDPTKNTSKINFFKKVFNEKILTDIHSIRNQNEFSDLLSEALYTGKAIGLSYGPAGLRHSLGHIISVWGADFDEDGNVVAIYVTDSDDKKLTIGDERVGLKRYKVSTDDEGRARLTAYTETDNTGGQVRGLYTLDTGTQAWADYFDKTEQTGTDQAEQLEHHHHHH

SEQ ID NO: 269 - protein, 361 aa, synthetic construct
MEVVEVWPYGQNPNGKTEILSQTEDSESLQRLRDIEDFQAEKKKEGVVYTKWLDGVDVDDHDFRKITDGDIEYYATPLLNGRGFYDINKDFNRDSDKCAAAVAANMFHYWLDRNRDNVDRFLKQNPEKHGIIELPDGQLKLSDFLNTYESDYGYRDKSKLFDFISNNFNGPVWTDKLLDNYINGYAYNYKYGRTIEDPTKNTSKINFFKEVFDEKLLTNNHSIRNYNEFSELLREALYTGKAIGLSYGPAGLRHSLGHIISVWGADLDEDGNVVAIYVTDSDDKKLTIGDERVGLKRYKVSSDDENRARLTAYEEKDNTGGEIRGLYTLDTGKQAWADYFDKTEQTGTDQAEQLEHHHHHH

SEQ ID NO: 270 - protein, 361 aa, synthetic construct
MEVVEVWPYGQNPNGKTEILSQTEDSESLQRLRDIEDFQAEKKKEGVVYTKWLDGVTVKDHDFRKIVDGNIEYYATPLLNGRGWYDINKDFNRDSDKCAAAVAANMFHYWLDRNRDNVDRFLKQNPEKHGIIELPDGQLKLSDFLNTYESDNGYRDKSKLFDFISKNFNGPVWTDKLLDNYINGYGYNYKYGRTIEDPTKNTSKINFFKKVFNEKILTDIHSIRNQNEFSDLLSEALYTGKAIGLSYGPAGLRHSLGHIISVWGADFDEDGNVVAIYVTDSDDKKLTIGDERVGLKRYKVSTDDEGRARLTAYTETDNTGGQVRGLWTLDTGTQAWADYFDKTEQTGTDQAEQLEHHHHHH

SEQ ID NO: 271 - protein, 361 aa, synthetic construct
MEVVEVWPYGQNPNGKTEILSQTEDSESLQRLRDIEDFQAEKKKENVVYTKWLDGVDVDDHDFRKIVDGNTEYYATPLLNGRGWYDINKDFNRDSDKCAAAVAANMFHYWLDQNRDNIDRFLRQSPEKHGIIELPDGQLKLSDFLNTYESDDGYRDKSKLFDFISNNFNGPVWTDKLLDNYINGYGYNYKYGRTIEDPTKNNSKINFFKKVFNGKILTDNHSIRNYNTFSDLLSEALYTGKAIGLSYGPAGLRHSLGHIISVWGADLDADGNVVAIYVTDSDDKKLTIGDERVGLKRYKISYDDENRARLTAYEENDNTGGQIRGLETLDTGKQAWADYFDKTEQTGTDQAEQLEHHHHHH

SEQ ID NO: 272 - protein, 361 aa, synthetic construct
MEVVEVWPYGQNPNGKTEILSQTEDSESLQRLRDIEDFQAEKKKQNVVYTKWLDGVTVDDSDFRKIKDGNTEYYATPLLNGRGFYDINKDFNRDSDKCAAAVAANMFHYWLDRNRDNVDRFLKQNPEKHGIIELPDGQLKLSDFLNTYESDNNYRDKSKLFDFISKNFNGPVWTNKLLDNYINGYGYNYKYGRTIEDPTKNTSKINFFKKVFNEKILTNVHQIFNYNEFSTLLSEALYTGKAIGLSYGPGGLRHSLGHIISVWGADLDADGNVVAIYVTDSDDKKLTIGDERVGLKRYKISTDDEGRARLTAYTETDNTGGQVRGIYTLDTGKQAWADYFDKTEQTGTDQAEQLEHHHHHH

SEQ ID NO: 273 - protein, 361 aa, synthetic construct
MEVVEVWPYGQNPNGKTEILSQTEDSESLQRLRDIEDFQAEKKKQGVVYTKWLDGVNVDDHEFRKITDGNTEYYATPLLNGRGYYDINKDFNRDSDKCAAAVAANMFHYWLDRNRDNVDRFLRQNPDKHGIIELPDGQLKLSDFLNTYESDHDYRDKSKLFDFISNNFNGPVWTNKLLDNYINGYGYNYKYGRTIEDPTKNTSKINFFKEVFNGKLLTDNHSIRNKNEFSSKLSEALYTGKAIGLSYGPAGLRHSLGHIISVWGADLDEDGNVVAIYVTDSDDKKLTIGDERVGLKRYKVSYDDEGRARLTAYEETDNTGGEIRGLYTLDTGKQYWADYFDKTEQTGTDQAEQLEHHHHHH

SEQ ID NO: 274 - protein, 361 aa, synthetic construct
MEVVEVWPYGQNPNGKTEILSQTEDSESLQRLRDIEDFQAEKKKQNVVYTKWLDGVTVDDSDFRKIKDGNTEYYATPLLNGRGFYDINKDFNRDSDKCAAAVAANMFHYWLDRNRDNVDRFLKQNPEKHGIIELPDGQLKLSDFLNTYESDNNYRDKSKLFDFISKNFNGPVWTNKLLDNYINGYGYNYKYGRTIEDPTKNTSKINFFKKVFNEKILTNVHQIFNYNEFSTLLSEALYTGKAIGLSYGPGGLRHSLGHIISVWGADLDADGNVVAIYVTDSDDKKLTIGDERVGLKRYKISTDDEGRARLTAYTETDNTGGQVRGIWTLDTGKQAWADYFDKTEQTGTDQAEQLEHHHHHH

SEQ ID NO: 275 - protein, 361 aa, synthetic construct
MEVVEVWPYGQNPNGKTEILSQTEDSESLQRLRDIEDFQAEKKKQGVVYTKWLDGVNVDDHEFRKITDGNTEYYATPLLNGRGYYDINKDFNRDSDKCAAAVAANMFHYWLDRNRDNVDRFLRQNPDKHGIIELPDGQLKLSDFLNTYESDHDYRDKSKLFDFISNNFNGPVWTNKLLDNYINGYGYNYKYGRTIEDPTKNTSKINFFKEVFNGKLLTDNHSIRNKNEFSSKLSEALYTGKAIGLSYGPAGLRHSLGHIISVWGADLDEDGNVVAIYVTDSDDKKLTIGDERVGLKRYKVSYDDEGRARLTAYEETDNTGGEIRGLWTLDTGKQYWADYFDKTEQTGTDQAEQLEHHHHHH

SEQ ID NO: 276 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKQAWADYFDKTEQTGTDQAEQLEHHHHHH

SEQ ID NO: 277 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKYAWADYFDKTEQTGTDQAEQLEHHHHHH

SEQ ID NO: 278 - protein, 361 aa, synthetic construct
MEVVEVWPYGQNPNGKTEILSQTEDSESLQRLRDIEDFQAEKKKENVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSDLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKQAWADYFDKTEQTGTDQAEQLEHHHHHH

SEQ ID NO: 279 - protein, 361 aa, synthetic construct
MEVVEVWPYGQNPNGKTEILSQTEDSESLQRLRDIEDFQAEKKKQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQLEHHHHHH

SEQ ID NO: 280 - protein, 361 aa, synthetic construct
MEVVEVWPYGQNPNGKTEILSQTEDSESLQRLRDIEDFQAEKKKENVVYTKWLDGVDVKDHDFRKIVDGNIEYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRARLTAYEETDNTGGQIRGLWTLDTGKQAWADYFDKTEQTGTDQAEQLEHHHHHH

SEQ ID NO: 281 - protein, 361 aa, synthetic construct
MEVVEVWPYGQNPNGKTEILSQTEDSESLQRLRDIEDFQAEKKKQNVVYTKWLDGVDVDDHDFRKIVDGNTEYYATPLLNGRGFYDINKDFNRDSDKCAAAVAANMFHYWLDRNRDNVDRFLRQNPEKHGIIELPDGQLKLSDFLNTYESDHGYRDKSKLFDFISNNFNGPVWTNKLLDNYINGYGYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRARLTAYEETDNTGGQIRGLWTLDTGKQAWADYFDKTEQTGTDQAEQLEHHHHHH

SEQ ID NO: 282 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLYTLDTGKYAWADYFDKTEQTGTDQAEQLEHHHHHH

SEQ ID NO: 283 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSDLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 284 - protein, 361 aa, synthetic construct
MEVVEVWPYGQNPNGKTEILSQTEDSESLQRLRDIEDFQAEKKKQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 285 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDNGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 286 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRARLTAYEETHNTGGQIRGLWTLDTGKYAWADYFDKTEQTGTDQAEQLEHHHHHH

SEQ ID NO: 287 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKEAWADYFDKTEQTGTDQAEQLEHHHHHH

SEQ ID NO: 288 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 289 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 290 - protein, 361 aa, synthetic construct
MEVVEVWPYGQNPNGKTEILSQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETDNTGGQIRGLWTLDTGKYAWADYFDKTEQTGTDQAEQLEHHHHHH

SEQ ID NO: 291 - protein, 361 aa, synthetic construct
MEVVEVWPYGQNPNGKTEILSQTEDSESLQRLRDIEDFQAEKKMQNVVYTKWLDGVDVDDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 292 - protein, 361 aa, synthetic construct
MEVVEVWPYGQNPNGKTEILSQTEDSESLQRLRDIEDFQAEKKMQNVVYTKWLDGVDVKDHDFRKIVDGNIEYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 293 - protein, 361 aa, synthetic construct
MEVVEVWPYGQNPNGKTEILSQTEDSESLQRLRDIEDFQAEKKMQNVVYTKWLDGVDVKDHDFRKIVDGGIAYYATPLLNGRGFYDINKDFNRDSDLCAAAVAANMFHYWLDINRDNVDRFLRQNPEKHGIIELPDGQLKLSDFLNTYESDHGYRDKSKLFDYISNNFNGPVWTDKLLDNYINGYGYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQLEHHHHHH

SEQ ID NO: 294 - protein, 361 aa, synthetic construct
MEVVEVWPYGQNPNGKTEILSQTEDSESLQRLRDIEDFQAEKKMQNVVYTKWLDGVDVKDHDFRKIVDGGTAYYATPLLNGRGFYDINKDFNRDSLLCSAAVAANMFHYWLDINRDNVDRFLRQNPEKHGIIELPDGQLKLSDFLNTYESDHGYRDKSKLFDYISNNFNGGLWTDKLLDNYINGYGYNKKYGRTIEDPTKNTSKINFFKEVFNEKILTNNHQIRNQNEFSVLLSEALYTGKAIGLSYGPAGLRHSLGHIISVWGADLDADGNVVAIYVTDSDDKKLTIGDERVGLKRYKISTDDNNRLRLTAYEETHNTGGQIRGLWTLDTGKYAWADYFDKTEQTGTDQAEQLEHHHHHH

SEQ ID NO: 295 - protein, 361 aa, synthetic construct
MEVVEVWPYGQNPNGKTEILSQTEDSESLQRLRDIEDFQAEKKMQNVVYTKWLDGVDVKDHDFRKIVDGDYAYYATPLLNGRGFYDINKDFNRDSDKCAAAVAANMFHYWLDINRDNVDRFLRQNPEKHGIIELPDGQLKLSDFLNTYESDHGYRDKSKLFDFISNAFNGPVWADKLLDNYINGYGYNKKYGRTIEDPTKNTSKFNFFKEVFNEKILTNNHQIRNQNEFSVLLSEALYTGKAIGLAYGPGGLRHSLGHIISVWGADLDADGNVVAIYVTDSDDKKLTIGDERVGLKRYKISTDDNNRLRLTTYEETHNTGAQIRGLETLDTGKYAWADYFDKTEQTGTDQAEQLEHHHHHH

SEQ ID NO: 296 - protein, 293 aa, synthetic construct
MVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSSGKVAISAKEIKEDNIGAQVLGLFTLSTGQDSWNQTN

SEQ ID NO: 297 - protein, 293 aa, synthetic construct
MVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 298 - protein, 293 aa, synthetic construct
MVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIYVTDSDSNPSIGMKKYFVGVNSSGKVAISAKEIKEDNIGAQVLGLFTLSTGQDSWNQTN

SEQ ID NO: 299 - protein, 293 aa, synthetic construct
MVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 300 - protein, 293 aa, synthetic construct
MVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIAVTDSDSNASIGMKKYFVGVNSSGKVAISAKEIKEDNIGAQVLGLFTLSTGQDSWNQTN

SEQ ID NO: 301 - protein, 293 aa, synthetic construct
MVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 302 - protein, 293 aa, synthetic construct
MVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 303 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 304 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 305 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 306 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 307 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 308 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYFVGVNSDGKVAISAKEIEEDNIGAQVLGLFTLSTGQDIWNQTN

SEQ ID NO: 309 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYPVGVNSNGKVAISAKEIEEDNIGAQVLGLFTLSTGQDIWNQTN

SEQ ID NO: 310 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 311 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 312 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 313 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 314 - protein, 293 aa, synthetic construct
MVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 315 - protein, 293 aa, synthetic construct
MVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 316 - protein, 293 aa, synthetic construct
MVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 317 - protein, 293 aa, synthetic construct
MVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 318 - protein, 293 aa, synthetic construct
MVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 319 - protein, 293 aa, synthetic construct
MVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 320 - protein, 293 aa, synthetic construct
MVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 321 - protein, 293 aa, synthetic construct
MVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 322 - protein, 293 aa, synthetic construct
MVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 323 - protein, 293 aa, synthetic construct
MVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 324 - protein, 293 aa, synthetic construct
MVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 325 - protein, 293 aa, synthetic construct
MVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 326 - protein, 293 aa, synthetic construct
MVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 327 - protein, 293 aa, synthetic construct
MVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 328 - protein, 293 aa, synthetic construct
MVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 329 - protein, 293 aa, synthetic construct
MVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 330 - protein, 293 aa, synthetic construct
MVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 331 - protein, 293 aa, synthetic construct
MVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 332 - protein, 293 aa, synthetic construct
MVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 333 - protein, 293 aa, synthetic construct
MVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 334 - protein, 293 aa, synthetic construct
MVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 335 - protein, 295 aa, synthetic construct
MVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVGINHVINLWGADFDSNGNLKAIYVTDSDSNASIGMKKYFVGVNSSGKVAISAKEIKEDNIGAQVLGLFTLSTGQDSWNQTN

SEQ ID NO: 336 - protein, 295 aa, synthetic construct
MVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYFVGVNSSGKVAISAKEIKEDNIGAQVLGLFTLSTGQDSWNQTN

SEQ ID NO: 337 - protein, 295 aa, synthetic construct
MVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYFVGVNSSGKVAISAKEIKEDNIGAQVLGLFTLSTGQDSWNQTN

SEQ ID NO: 338 - protein, 295 aa, synthetic construct
MVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSAGKVAISAKEIKEDNIGAQVLGLFTLSTGQDSWNQTN

SEQ ID NO: 339 - protein, 295 aa, synthetic construct
MVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYGVGVNSAGKVAISAKEIKEDNIGAQVLGLFTLSTGQDSWNQTN

SEQ ID NO: 340 - protein, 295 aa, synthetic construct
MVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYGVGVNSAGKVAISAKEIKEDNIGAQVLGLFTLSTGQDSWNQTN

SEQ ID NO: 341 - protein, 295 aa, synthetic construct
MVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSSGKVAISAKEIKEDNIGAQVLGLFTLSTGQDSWNQTN

SEQ ID NO: 342 - protein, 295 aa, synthetic construct
MVTSVWTKGVTPPAKFTQGEDVFHAPYVANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 343 - protein, 295 aa, synthetic construct
MVTSVWTKGVTPPAKFTQGEDVFHAPYDANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 344 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 345 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 346 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 347 - protein, 295 aa, synthetic construct
MVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 348 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 349 - protein, 295 aa, synthetic construct
MVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 350 - protein, 295 aa, synthetic construct
MVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 351 - protein, 295 aa, synthetic construct
MVTSVWTKGVTPPADFTQGEDVFHAPYVANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 352 - protein, 295 aa, synthetic construct
MVTSVWTKGVTPPADFTQGEDVFHAPYDANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 353 - protein, 295 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 354 - protein, 295 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 355 - protein, 295 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 356 - protein, 295 aa, synthetic construct
MVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 357 - protein, 295 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 358 - protein, 295 aa, synthetic construct
MVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 359 - protein, 295 aa, synthetic construct
MVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 360 - protein, 295 aa, synthetic construct
MVTSVWTKGVTPPTDFIKGEDVFHAPYKAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 361 - protein, 295 aa, synthetic construct
MVTSVWTKGVTPPTDFIKGEDVFHAPYDAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 362 - protein, 299 aa, synthetic construct
MQITSVWTKGVTPLTPEQFRKNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGRNAHGHVAISAKKIEGENIGAQVLGLFTLSSGKDIWQKLS

SEQ ID NO: 363 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSLGKDIWQKLS

SEQ ID NO: 364 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 365 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 366 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFNNQEWFDLKAAIDTKDSQTNSQLFNYFRDKAFPNLSARQLGVMPDLVLDMFINGYYLNVPKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYAVGINAHGHVAISAKKIEGENIGAQVLGLFTLSSGKDIWQKLS

SEQ ID NO: 367 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANPSIGMKKYFVGRNAHGHVAISAKKIEGENIGAQVLGLFTLSSGKDIWQKLS

SEQ ID NO: 368 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 369 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDQWQKLS

SEQ ID NO: 370 - protein, 299 aa, synthetic construct
MQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 371 - protein, 299 aa, synthetic construct
MTITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 372 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 373 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQEWFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSLGQDIWQKLS

SEQ ID NO: 374 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 375 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 376 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDQWQKLS

SEQ ID NO: 377 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 378 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 379 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 380 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 381 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 382 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 383 - protein, 299 aa, synthetic construct
MTITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 384 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 385 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 386 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 387 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 388 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 389 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 390 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 391 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 392 - protein, 299 aa, synthetic construct
MTITSVWTKGVTPPTPEDFRKNNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDIWQKLS

SEQ ID NO: 393 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSLGQDIWQKLS

SEQ ID NO: 394 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 395 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 396 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYAVGVNAHGKVAISAKKIEGDNIGAQVLGLFTLSTGQDIWQKLS

SEQ ID NO: 397 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANPSIGMKKYFVGRNAHGKVAISAKKIEGDNIGAQVLGLFTLSTGQDIWQKLS

SEQ ID NO: 398 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 399 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDQWQKLS

SEQ ID NO: 400 - protein, 299 aa, synthetic construct
MTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 401 - protein, 334 aa, synthetic construct
MSQTEDSESLQRLRDIEDFQAEKEMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 402 - protein, 334 aa, synthetic construct
MSQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 403 - protein, 334 aa, synthetic construct
MSQTEDSESLQRLRDIEDFQAEKKDQNVVYTKWLDGVDVKDHDFRKIVDGNIAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 404 - protein, 334 aa, synthetic construct
MSQTEDSESLQRLRDIEDFQAEKKDQNVVYTKWLDGVDVKDHDFRKIVDGNIAYYATPLLNGRGLYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 405 - protein, 334 aa, synthetic construct
MSQTEDSESLQRLRDIEDFQAEKKDQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 406 - protein, 334 aa, synthetic construct
MSQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 407 - protein, 334 aa, synthetic construct
MSQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 408 - protein, 334 aa, synthetic construct
MSQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 409 - protein, 334 aa, synthetic construct
MSQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 410 - protein, 334 aa, synthetic construct
MSQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 411 - protein, 334 aa, synthetic construct
MSQTEDSESLQRLRDIEDFQAEKEKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 412 - protein, 334 aa, synthetic construct
MSQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 413 - protein, 334 aa, synthetic construct
MSQTEDSESLQRLRDIEDFQAEKKDQNVVYTKWLDGVDVKDHDFRKIVDGNIAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 414 - protein, 334 aa, synthetic construct
MSQTEDSESLQRLRDIEDFQAEKKDQNVVYTKWLDGVDVKDHDFRKIVDGNIAYYATPLLNGRGLYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 415 - protein, 334 aa, synthetic construct
MSQTEDSESLQRLRDIEDFQAEKKDQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 416 - protein, 334 aa, synthetic construct
MSQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 417 - protein, 334 aa, synthetic construct
MSQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 418 - protein, 334 aa, synthetic construct
MSQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 419 - protein, 334 aa, synthetic construct
MSQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 420 - protein, 334 aa, synthetic construct
MSQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 421 - protein, 334 aa, synthetic construct
MSQTEDSESLQRLRDIEDFQAEKEKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 422 - protein, 334 aa, synthetic construct
MSQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 423 - protein, 334 aa, synthetic construct
MSQTEDSESLQRLRDIEDFQAEKKDQNVVYTKWLDGVDVKDHDFRKIVDGNIAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 424 - protein, 334 aa, synthetic construct
MSQTEDSESLQRLRDIEDFQAEKKDQNVVYTKWLDGVDVKDHDFRKIVDGNIAYYATPLLNGRGLYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 425 - protein, 334 aa, synthetic construct
MSQTEDSESLQRLRDIEDFQAEKKDQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 426 - protein, 334 aa, synthetic construct
MSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 427 - protein, 334 aa, synthetic construct
MSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 428 - protein, 334 aa, synthetic construct
MSQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 429 - protein, 334 aa, synthetic construct
MSQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 430 - protein, 334 aa, synthetic construct
MSQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDSTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 431 - protein, 293 aa, synthetic construct
MVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 432 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 433 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPSLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 434 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 435 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANARINHVINLWGADFDAEGNLEAIYVTDSDSNASIGMKKYFVGVNSNGKVAISAKEIEEDNIGAQVLGLFTLSTGQDIWNQTN

SEQ ID NO: 436 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSNGKVAISAKEIEEDNIGAQVLGLFTLSTGQDIWNQTN

SEQ ID NO: 437 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYVVGVNSNGKVAISAKEIEEDNIGAQVLGLFTLSTGQDIWNQTN

SEQ ID NO: 438 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 439 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 440 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANGRINHVINLWGADFDAEGNLEAIYVTDSDSNASIGMKKYFVGVNSNGKVAISAKEIEEDNIGAQVLGLFTLSTGQDIWNQTN

SEQ ID NO: 441 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSNGKVAISAKEIEEDNIGAQVLGLFTLSTGQDIWNQTN

SEQ ID NO: 442 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 443 - protein, 293 aa, synthetic construct
MVTSVWTKGVTPPTNFTYGEDVLHAPYVANQGWYDITKTFNGKDTLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 444 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFKGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 445 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQLFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 446 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDKRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 447 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGVQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 448 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 449 - protein, 293 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSEASIGMKKYFVGVNSNGKVAISAKEIEEDNIGAQVLGLFTLSTGQDIWNQTN

SEQ ID NO: 450 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPTLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 451 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTTANVRINHVINLWGADFDSDGNLKAIYVTDSDSNASIGMKKYFVGVNSAGKVAISAKEIKEDNIGAQVLGLFTLSTGQDIWNQTN

SEQ ID NO: 452 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSAGKVAISAKEIKEDNIGAQVLGLFTLSTGQDIWNQTN

SEQ ID NO: 453 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYDVGVNSAGKVAISAKEIKEDNIGAQVLGLFTLSTGQDIWNQTN

SEQ ID NO: 454 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYVVGVNSAGKVAISAKEIKEDNIGAQVLGLFTLSTGQDIWNQTN

SEQ ID NO: 455 - protein, 295 aa, synthetic construct
MVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 456 - protein, 295 aa, synthetic construct
MVTSVWTKGVTPPADFTQGEDVFHAPYVANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 457 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSAGKVAISAKEIKEDNIGAQVLGLFTLSTGQDIWNQTN

SEQ ID NO: 458 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 459 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSAGKVAISAKEIKEDNIGAQVLGLFTLSTGQDIWNQTN

SEQ ID NO: 460 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYGVGVNSAGKVAISAKEIKEDNIGAQVLGLFTLSTGQDIWNQTN

SEQ ID NO: 461 - protein, 295 aa, synthetic construct
MVTSVWTKGVTPPADFTQGEDVFHAPYVANQGWYDITKTFNRKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 462 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIIFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 463 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVFPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 464 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 465 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTN

SEQ ID NO: 466 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSRASIGMKKYFVGVNSAGKVAISAKEIKEDNIGAQVLGLFTLSTGQDIWNQTN

SEQ ID NO: 467 - protein, 295 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNAAGKVAISAKEIKEDNIGAQVLGLFTLSTGQDIWNQTN

SEQ ID NO: 468 - protein, 299 aa, synthetic construct
MTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 469 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 470 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFLDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 471 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 472 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANASIGMKKYFVGVNANGKVAISAKKIEGDNIGAQVLGLFTLSTGQDIWQKLS

SEQ ID NO: 473 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 474 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDQWQKLS

SEQ ID NO: 475 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 476 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 477 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANPSIGMKKYFVGVNANGKVAISAKKIEGDNIGAQVLGLFTLSTGQDIWQKLS

SEQ ID NO: 478 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 479 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSLGQDIWQKLS

SEQ ID NO: 480 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 481 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVFPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 482 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 483 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDTNASIGMKKYFVGVNANGKVAISAKKIEGDNIGAQVLGLFTLSTGQDIWQKLS

SEQ ID NO: 484 - protein, 299 aa, synthetic construct
MTITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDARASIGMKKYFVGVNANGKVAISAKKIEGDNIGAQVLGLFTLSTGQDIWQKLS

SEQ ID NO: 485 - protein, 334 aa, synthetic construct
MSQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 486 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 487 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNSKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 488 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 489 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 490 - protein, 334 aa, synthetic construct
MSQTEDSESLQRLRDIEDFQAEKEKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 491 - protein, 334 aa, synthetic construct
MSQTEDSESLQRLRDIEDFQAEKKDQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 492 - protein, 334 aa, synthetic construct
MSQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 493 - protein, 334 aa, synthetic construct
MSQTEDSESLQRLRDIEDFQAEKKKQNVVYTKWLDGVDVKDHDFRKIVDGNIAYYATPLLNGRGLYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 494 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRLIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 495 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 496 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 497 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 498 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDEQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 499 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNKPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 500 - protein, 334 aa, synthetic construct
MSQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 501 - protein, 301 aa, synthetic construct
MVTSVWTKGVTPPTDFIKGEDVFHAPYKAGQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 502 - protein, 301 aa, synthetic construct
MVTSVWTKGVTPPTDFIKGEDVFHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 503 - protein, 301 aa, synthetic construct
MVTSVWTKGVTPPTDFIKGEDVFHAPYKAGQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 504 - protein, 305 aa, synthetic construct
MVTSVWTKGVTPPTDFRKIVDGNIAYYHAPYKAGQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 505 - protein, 305 aa, synthetic construct
MVTSVWTKGVTPPTDFRKIVDGNIAYYHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 506 - protein, 305 aa, synthetic construct
MVTSVWTKGVTPPANFRKIVDGNIAYYHAPYKANQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 507 - protein, 301 aa, synthetic construct
MVTSVWTKGVTPPANFTQGEDVFHAPYKANQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 508 - protein, 301 aa, synthetic construct
MVTSVWTKGVTPPANFTQGEDVFHAPYKANQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNLEHHHHHH

SEQ ID NO: 509 - protein, 301 aa, synthetic construct
MITSVWTKGVTPPTDFIKGEDVFHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKRQEKDPRGGIFDAVFGRGDQTKLLTSRHDFKEKTLNEISQLIKQELTEGKALALSHTYANVRINHVINLWGADFDAEGNLEAIYVTDSDSNASIGMKKYFVGVNSAGKVAISAKEIEDDNIGAQVLGLFTLSTGQKIWNKTNLEHHHHHH

SEQ ID NO: 510 - protein, 301 aa, synthetic construct
MITSVWTKGVTPPTDFIKGEDVFHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKRQEKDPRGGIFDAVFGRGDQTKLLTSRHDLKNKTLNEISQLIKQELTEGKALALSHTYANVRINHVINLWGADFDAEGNLEAIYVTDSDSNASIGMKKYFVGVNSAGKVAISAKEIEDDNIGAQVLGLFTLSTGQKIWNKTNLEHHHHHH

SEQ ID NO: 511 - protein, 301 aa, synthetic construct
MITSVWTKGVTPPTDFIKGEDVFHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKEGSKDPRGGIFDAVFTRGDQSKLLTSRHDLKNKTLNEISQLIKQELTEGKALALSHTYANVRINHVINLWGADFDAEGNLEAIYVTDSDSNASIGMKKYFVGVNSAGKVAISAKEIEDDNIGAQVLGLFTLSTGQDIWNQTNLEHHHHHH

SEQ ID NO: 512 - protein, 301 aa, synthetic construct
MVTSVWTKGVTPPTDFIKGEDVFHAPYKAGQGWYDITKAFDGGDDLLCGAATAGNMLHWWFDQNKDQIEAYLKEHPEKQKINFNGEQMFDVKEAIDTKDDQTNSELFNYFKEKAFPYLSTKHLGVFPDHVLDMFINGYRLSLTNHGPTPVKRQEKDPRGGIFDAVFGRGDQTKLLTSRHDLKNKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQKIWNKTNLEHHHHHH

SEQ ID NO: 513 - protein, 301 aa, synthetic construct
MVTSVWTKGVTPPTDFIKGEDVFHAPYKAGQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 514 - protein, 301 aa, synthetic construct
MVTSVWTKGVTPPTDFIKGEDVFHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 515 - protein, 301 aa, synthetic construct
MVTSVWTKGVTPPTDFIKGEDVFHAPYKAGQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 516 - protein, 305 aa, synthetic construct
MVTSVWTKGVTPPTDFRKIVDGNIAYYHAPYKAGQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 517 - protein, 305 aa, synthetic construct
MVTSVWTKGVTPPTDFRKIVDGNIAYYHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 518 - protein, 305 aa, synthetic construct
MVTSVWTKGVTPPANFRKIVDGNIAYYHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 519 - protein, 301 aa, synthetic construct
MVTSVWTKGVTPPANFTQGEDVFHAPYVANQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 520 - protein, 301 aa, synthetic construct
MVTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNLEHHHHHH

SEQ ID NO: 521 - protein, 301 aa, synthetic construct
MITSVWTKGVTPPTDFIKGEDVFHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKRQEKDPRGGIFDAVFGRGDQTKLLTSRHDFKEKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQKIWNKTNLEHHHHHH

SEQ ID NO: 522 - protein, 301 aa, synthetic construct
MITSVWTKGVTPPTDFIKGEDVFHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKRQEKDPRGGIFDAVFGRGDQTKLLTSRHDLKNKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQKIWNKTNLEHHHHHH

SEQ ID NO: 523 - protein, 301 aa, synthetic construct
MITSVWTKGVTPPTDFIKGEDVFHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKEGSKDPRGGIFDAVFTRGDQSKLLTSRHDLKNKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQDIWNQTNLEHHHHHH

SEQ ID NO: 524 - protein, 301 aa, synthetic construct
MVTSVWTKGVTPPTDFIKGEDVFHAPYKAGQGWYDITKAFDGGDDLLCGAATAGNMLHWWFDQNKDQIERYLKEHPEKQKINFNGEQMFDVKEAIDTKDSQTNSELFNYFKEKAFPYLSTKHLGVFPDHVLDMFINGYRLSLTNHGPTPVKRQEKDPRGGIFDAVFGRGDQTKLLTSRHDLKNKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQKIWNKTNLEHHHHHH

SEQ ID NO: 525 - protein, 301 aa, synthetic construct
MVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 526 - protein, 301 aa, synthetic construct
MVTSVWTKGVTPPTDFIYGEDVLHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 527 - protein, 301 aa, synthetic construct
MVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 528 - protein, 305 aa, synthetic construct
MVTSVWTKGVTPPTDFRKIVDGNIAYYHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 529 - protein, 305 aa, synthetic construct
MVTSVWTKGVTPPTDFRKIVDGNIAYYHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 530 - protein, 305 aa, synthetic construct
MVTSVWTKGVTPPTNFRKIVDGNIAYYHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 531 - protein, 301 aa, synthetic construct
MVTSVWTKGVTPPTNFTYGEDVLHAPYVANQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 532 - protein, 301 aa, synthetic construct
MVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 533 - protein, 301 aa, synthetic construct
MITSVWTKGVTPPTDFIYGEDVLHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRQEKDPRGGIFDAVFGRGDQTKLLTNRHDFKEKTLNEISQLIKQELTEGKALGISHTYANVRINHVINLWGADFDAEGNLEAIYVTDSDSNASIGMKKYFVGVNSNGKVAISAKEIEEDNIGAQVLGLFTLSTGQKIWNKTNLEHHHHHH

SEQ ID NO: 534 - protein, 301 aa, synthetic construct
MITSVWTKGVTPPTDFIYGEDVLHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRQEKDPRGGIFDAVFGRGDQTKLLTNRHDLKNKTLNEISQLIKQELTEGKALGISHTYANVRINHVINLWGADFDAEGNLEAIYVTDSDSNASIGMKKYFVGVNSNGKVAISAKEIEEDNIGAQVLGLFTLSTGQKIWNKTNLEHHHHHH

SEQ ID NO: 535 - protein, 301 aa, synthetic construct
MITSVWTKGVTPPTDFIYGEDVLHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDLKNKTLNEISQLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNLEHHHHHH

SEQ ID NO: 536 - protein, 301 aa, synthetic construct
MVTSVWTKGVTPPTDFIYGEDVLHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRQEKDPRGGIFDAVFGRGDQTKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQKIWNKTNLEHHHHHH

SEQ ID NO: 537 - protein, 301 aa, synthetic construct
MVTSVWTKGVTPPTDFIKGEDVFHAPYKAGQGWYDITKTFNGKDNLLCGAATAGNMLHWWFDQNKDQIEAYLKEHPEKQKIIFNNQELFDLKAAIDTKDDQTNSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTNLEHHHHHH

SEQ ID NO: 538 - protein, 301 aa, synthetic construct
MVTSVWTKGVTPPTDFIKGEDVFHAPYKAGQGWYDITKTFNGKDNLLCGAATAGNMLHWWFDQNKDQIEAYLKEHPEKQKIIFNNQELFDLKAAIDTKDDQTNSKLFEYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTNLEHHHHHH

SEQ ID NO: 539 - protein, 305 aa, synthetic construct
MVTSVWTKGVTPPTDFRKIVDGNIAYYHAPYKAGQGWYDITKAFDGGDNLLCGAATAGNMLHWWFDQNKDQIEAYLKEHPEKQKIIFNNQELFDLKAAIDTKDDQTNSELFNYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTNLEHHHHHH

SEQ ID NO: 540 - protein, 301 aa, synthetic construct
MVTSVWTKGVTPPANFTQGEDVFHAPYKANQGWYDITKTFNGKDNLLCGAATAGNMLHWWFDQNKDQIEAYLKEHPEKQKIIFNNQELFDLKAAIDTKDDQTNSKLFEYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTNLEHHHHHH

SEQ ID NO: 541 - protein, 301 aa, synthetic construct
MVTSVWTKGVTPPTDFIKGEDVFHAPYKAGQGWYDITKTFNGKDNLLCGAATAGNMLHWWFDQNKDQIERYLKEHPEKQKIIFNNQELFDLKAAIDTKDSQTDSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTNLEHHHHHH

SEQ ID NO: 542 - protein, 301 aa, synthetic construct
MVTSVWTKGVTPPTDFIKGEDVFHAPYKAGQGWYDITKTFNGKDNLLCGAATAGNMLHWWFDQNKDQIERYLKEHPEKQKIIFNNQELFDLKAAIDTKDSQTDSKLFEYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTNLEHHHHHH

SEQ ID NO: 543 - protein, 305 aa, synthetic construct
MVTSVWTKGVTPPTDFRKIVDGNIAYYHAPYKAGQGWYDITKAFDGGDNLLCGAATAGNMLHWWFDQNKDQIERYLKEHPEKQKIIFNNQELFDLKAAIDTKDSQTNSELFNYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTNLEHHHHHH

SEQ ID NO: 544 - protein, 301 aa, synthetic construct
MVTSVWTKGVTPPANFTQGEDVFHAPYVANQGWYDITKTFNGKDNLLCGAATAGNMLHWWFDQNKDQIERYLKEHPEKQKIIFNNQELFDLKAAIDTKDSQTDSKLFEYFKEKAFPYLSTKHLGVFPDHVLDMFINGYRLSLTNHGPTPVKEGSKDKRGGIFDAVFTRGVQSKLLTSRHDLKNKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTNLEHHHHHH

SEQ ID NO: 545 - protein, 301 aa, synthetic construct
MVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNLEHHHHHH

SEQ ID NO: 546 - protein, 301 aa, synthetic construct
MVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNLEHHHHHH

SEQ ID NO: 547 - protein, 305 aa, synthetic construct
MVTSVWTKGVTPPTDFRKIVDGNIAYYHAPYKAGQGWYDITKAFDGGDNLLCGAATAGNMLHWWFDQNKEQIENYLKKHPEKQKIIFNNQELFDLKAAIDTKDSQTNSELFNYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNLEHHHHHH

SEQ ID NO: 548 - protein, 301 aa, synthetic construct
MVTSVWTKGVTPPTNFTYGEDVLHAPYVANQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNLEHHHHHH

SEQ ID NO: 549 - protein, 303 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 550 - protein, 303 aa, synthetic construct
MVTSVWTKGVTPPTDFIKGEDVFHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 551 - protein, 303 aa, synthetic construct
MVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 552 - protein, 307 aa, synthetic construct
MVTSVWTKGVTPPTDFRKIVDGNIAYYHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 553 - protein, 307 aa, synthetic construct
MVTSVWTKGVTPPTDFRKIVDGNIAYYHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 554 - protein, 307 aa, synthetic construct
MVTSVWTKGVTPPADFRKIVDGNIAYYHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 555 - protein, 303 aa, synthetic construct
MVTSVWTKGVTPPADFTQGEDVFHAPYVANQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 556 - protein, 303 aa, synthetic construct
MVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNLEHHHHHH

SEQ ID NO: 557 - protein, 303 aa, synthetic construct
MITSVWTKGVTPPTDFIKGEDVFHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRQEQEKDKRGGIFDAVFGRGDQTKLLTSRHDFKEKGLNEISQLIKQELTEGKALGLSHTYANVRINHVINLWGADFDADGNLEAIYVTDSDSNASIGMKKYFVGVNSAGKVAISAKEIKEDNIGAQVLGLFTLSTGQKIWNKTNLEHHHHHH

SEQ ID NO: 558 - protein, 303 aa, synthetic construct
MITSVWTKGVTPPTDFIKGEDVFHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRQEQEKDKRGGIFDAVFGRGDQTKLLTSRHDLKNKGLNEISQLIKQELTEGKALGLSHTYANVRINHVINLWGADFDADGNLEAIYVTDSDSNASIGMKKYFVGVNSAGKVAISAKEIKEDNIGAQVLGLFTLSTGQKIWNKTNLEHHHHHH

SEQ ID NO: 559 - protein, 303 aa, synthetic construct
MITSVWTKGVTPPTDFIKGEDVFHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLNEISQLIKQELTEGKALGLSHTYANVRINHVINLWGADFDADGNLEAIYVTDSDSNASIGMKKYFVGVNSAGKVAISAKEIKEDNIGAQVLGLFTLSTGQDIWNQTNLEHHHHHH

SEQ ID NO: 560 - protein, 303 aa, synthetic construct
MVTSVWTKGVTPPTDFIKGEDVFHAPYKAGQGWYDITKAFDGGDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRQEQEKDKRGGIFDAVFGRGDQTKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQKIWNKTNLEHHHHHH

SEQ ID NO: 561 - protein, 303 aa, synthetic construct
MITSVWTKGVTPPTDFIKGEDVFHAPYKAGQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 562 - protein, 303 aa, synthetic construct
MITSVWTKGVTPPTDFIKGEDVFHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 563 - protein, 303 aa, synthetic construct
MITSVWTKGVTPPTDFIKGEDVFHAPYKAGQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 564 - protein, 307 aa, synthetic construct
MITSVWTKGVTPPTDFRKIVDGNIAYYHAPYKAGQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 565 - protein, 307 aa, synthetic construct
MITSVWTKGVTPPTDFRKIVDGNIAYYHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 566 - protein, 307 aa, synthetic construct
MITSVWTKGVTPPAKFRKIVDGNIAYYHAPYVANQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 567 - protein, 303 aa, synthetic construct
MITSVWTKGVTPPAKFTQGEDVFHAPYVANQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 568 - protein, 303 aa, synthetic construct
MITSVWTKGVTPPAKFTQGEDVFHAPYVANQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNLEHHHHHH

SEQ ID NO: 569 - protein, 303 aa, synthetic construct
MITSVWTKGVTPPTDFIKGEDVFHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRQEQTKDRRGGIFDAVFGRGDQTKLLTERHDFKEKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQKIWNKTNLEHHHHHH

SEQ ID NO: 570 - protein, 303 aa, synthetic construct
MITSVWTKGVTPPTDFIKGEDVFHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRQEQTKDRRGGIFDAVFGRGDQTKLLTERHDLKNKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQKIWNKTNLEHHHHHH

SEQ ID NO: 571 - protein, 303 aa, synthetic construct
MITSVWTKGVTPPTDFIKGEDVFHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDLKNKTLNEISQLIKQELTEGKALGLSHTYANVRINHVINLWGADFDAEGNLEAIYVTDSDSNASIGMKKYFVGVNSAGKVAISAKEIKEDNIGAQVLGLFTLSTGQDIWNQTNLEHHHHHH

SEQ ID NO: 572 - protein, 303 aa, synthetic construct
MITSVWTKGVTPPTDFIKGEDVFHAPYKAGQGWYDITKAFDGGDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRQEQTKDRRGGIFDAVFGRGDQTKLLTERHDLKNKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQKIWNKTNLEHHHHHH

SEQ ID NO: 573 - protein, 303 aa, synthetic construct
MVTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTNLEHHHHHH

SEQ ID NO: 574 - protein, 303 aa, synthetic construct
MVTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTNLEHHHHHH

SEQ ID NO: 575 - protein, 307 aa, synthetic construct
MVTSVWTKGVTPPTDFRKIVDGNIAYYHAPYKAGQGWYDITKAFDGGDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTNLEHHHHHH

SEQ ID NO: 576 - protein, 303 aa, synthetic construct
MVTSVWTKGVTPPADFTQGEDVFHAPYVANQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTNLEHHHHHH

SEQ ID NO: 577 - protein, 303 aa, synthetic construct
MITSVWTKGVTPPTDFIKGEDVFHAPYKAGQGWYDITKTFNGKDNLLCGAATAGNMLHWWFDQNKEEIEAYLKKHPEKQKIIFNNQELFDLKAVINTKDSQTNSALFNYFKDKAFPNLSARRLGVFPDLVLDMFINGYYLNVYKTQTTDVNRTYQTKDRRGGIFDAVFTRGVQSKLLTERHDFKEKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTNLEHHHHHH

SEQ ID NO: 578 - protein, 303 aa, synthetic construct
MITSVWTKGVTPPTDFIKGEDVFHAPYKAGQGWYDITKTFNGKDNLLCGAATAGNMLHWWFDQNKEEIEAYLKKHPEKQKIIFNNQELFDLKAVINTKDSQTNSALFNYFKDKAFPNLSARRLGVFPDLVLDMFINGYYLNVYKTQTTDVNRTYQTKDRRGGIFDAVFTRGVQSKLLTERHDLKNKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTNLEHHHHHH

SEQ ID NO: 579 - protein, 307 aa, synthetic construct
MITSVWTKGVTPPTDFRKIVDGNIAYYHAPYKAGQGWYDITKAFDGGDNLLCGAATAGNMLHWWFDQNKEEIEAYLKKHPEKQKIIFNNQELFDLKAVINTKDSQTNSALFNYFKDKAFPNLSARRLGVFPDLVLDMFINGYYLNVYKTQTTDVNRTYQTKDRRGGIFDAVFTRGVQSKLLTERHDLKNKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTNLEHHHHHH

SEQ ID NO: 580 - protein, 303 aa, synthetic construct
MITSVWTKGVTPPAKFTQGEDVFHAPYVANQGWYDITKTFNGKDNLLCGAATAGNMLHWWFDQNKEEIEAYLKKHPEKQKIIFNNQELFDLKAVINTKDSQTNSALFNYFKDKAFPNLSARRLGVFPDLVLDMFINGYYLNVYKTQTTDVNRTYQTKDRRGGIFDAVFTRGVQSKLLTERHDLKNKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTNLEHHHHHH

SEQ ID NO: 581 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIERYLKKHPEKQKINFNGEQMFDVKEAIDTKDSQTDSALFEYFKDKAFPNLSTKHLGVMPDHVLDMFINGYYLSLGKHGPTPVKRGTKDPRGGIFDAVFTRGDQSKLLTSRHDFKEKTLKEISDLIKQELTEGKALALSHTYANVRINHVINLWGADFDSEGNLEAIYVTDSDSNASIGMKKYYVGVNSAGKVAISAKEIEGDNIGAQVLGLFTLSTGQDIWEQTNLEHHHHHH

SEQ ID NO: 582 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPNLSTKHLGVMPDLVLDMFINGYYLSLGKHGPTPVKRGTKDPRGGIFDAVFTRGDQSKLLTSRHDFKEKTLNEISDLIKQELTEGKALALSHTYANVRINHVINLWGADFNSEGNLEAIYVTDSDSNASIGMKKYYVGVNSAGKVAISAKEIEGDNIGAQVLGLFTLSTGQDIWEQTNLEHHHHHH

SEQ ID NO: 583 - protein, 315 aa, synthetic construct
MANQEIRYSEETPKTITSVWTKGVTPPTDFIQNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPNLSTKHLGVMPDLVLDMFINGYYLSLGKHGPTPVKRGTKDPRGGIFDAVFTRGDQSKLLTARHDFKEKTLNEISDLIKQELTEGKALALSHTYANVRINHVINLWGADFNSEGNLEAIYVTDSDSNASIGMKKYYVGVNAAGKVAISAKEIEGDNIGAQVLGLFTLSTGQDIWEQTNLEHHHHHH

SEQ ID NO: 584 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPNLSTKHLGVMPDLVLDMFINGYYLSLGKHGPTPVKRGTKDPRGGIFDAVFTRGDQTKLLTARHDFKEKTLNEISDLIKQELTEGKALALSHTYANVRINHVINLWGADFNSEGNLEAIYVTDSDSNASIGMKKYYVGVNAAGKVAISAKEIEGDNIGAQVLGLFTLSTGQDIWEQTNLEHHHHHH

SEQ ID NO: 585 - protein, 315 aa, synthetic construct
MANQEIRYSEETPKTITSVWTKGVTPPTDFIQNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVMPDLVLDMFINGYYLSVGKHGPTPVKRGTKDPRGGIFDAVFTRGDQSKLLTARHDFKEKTLNEISDLIKQELTEGKALALSHTYANVRINHVINLWGADFNSEGNLEAIYVTDSDSNASIGMKKYYVGVNAAGKVAISAKEIEGDNIGAQVLGLFTLSTGQDIWEQTNLEHHHHHH

SEQ ID NO: 586 - protein, 315 aa, synthetic construct
MANQEIRYSEDTPSHITSVWTKGVTPPTQFIQNEDVLHAPYIANQGWYDITKTFNGKDDLLCGAATAGNMLHWWFDQNKEQIEAYLKKYPEKQKINFNGEQMFDVKEAIDTKDSQTDSALFNYFRDKAFPNLSTKHLGVMPDHVIDMFINGYRLNLGNHGPTPVKNQTKDLRGGIFDAVFTRGDQSKLLTARHDFKEKTLKEISQLIKQELTEGKALALSHTYANVRINHVINLWGADFNAEGNLEAIYVTDSDSNASIGMKKYYVGVNAAGKVAISAKEIEGDNIGAQVLGLFTLSSGQDIWQQTNLEHHHHHH

SEQ ID NO: 587 - protein, 315 aa, synthetic construct
MANQEIRYSEETPKTITSIWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSKLFEYFKDKAFPYLSTKHLGVMPDLVLDMFINGYYLSLGKHGPTPVKRGTKDPRGGIFDAVFTRGDQSKLLTARHDFKEKTLNEISDLIKQELTEGKALALSHTYANVRINHVINLWGADFNSEGNLEAIYVTDSDSNASIGMKKYYVGVNAAGKVAISAKEIEGDNIGAQVLGLFTLSTGQDIWNQTNLEHHHHHH

SEQ ID NO: 588 - protein, 315 aa, synthetic construct
MANQEIRYSSDSEWANKKVWVYGITPPEEGAWKYSTYYLPWKKEYGWYDCNKRNPTADGMMCWAATASNLLHWWIAQNKEYIDLYGDKYKGPDKINFNGEQMFDVKEYIDPLDKPQESDIFQCFIDKSFADLSTKHEAGYGDAGINWFIHGIIPSSPAHGPTPVKLDYPYNPAGYFKDVFPRGDGVVLLGNNGDFKELSKERFNETIKDALKNKKAIGLSIGPVNVRSSHVVTIWGAEFDENGDVSYIYMADNNDRWGVGCIRYQIVYEEGGTYTCYKTEIIPSDRPIPINRLVTLELGEEYWKQTNLEHHHHHH

SEQ ID NO: 589 - protein, 315 aa, synthetic construct
MANQEIRYSSDSEWANKKVWVYGITPPEEGAWKYSTYYLPWKKEYGWYDCNKRNPTADGMMCWAATASNLLHWWIAQNKEYIDLYGDKYKGPDKINFNGEQMFDVKEYIDPLDKPQESDIFQCFIDKSFADLSTKHEAGYGDAGINWFIHGIIPSSPAHGPTPVKLDYPYNPAGYFKDVFPRGDGVVLLGNNGDFKELSKERFNETIKDALKNKKAIGLSIGPVNVRSSHVVTIWGAEFDENGDVSYIYMADNNDNWGVGCIRYQIVYEEGGTYTCYKTEIIPSDRPIPINRLVTLELGEEYWKQTNLEHHHHHH

SEQ ID NO: 590 - protein, 315 aa, synthetic construct
MANQEIRYSGDSEWANKKVWVYGITPPEEKAWFYSTYYLPWKKEYGWYDCNKRNPTADGMMCWAATASNLMHWWIAQNKEYIDLYGDKYKGPDKINFNGEQMFDVKEYIDPLDKPQESDIFQCFIDKAFADLSTKHEAGKGDEGINWFIHGIIPSYPAHGPTPVKLRYPYNPAGYFKDVFPRGDGVVLLGNNGDFKELGKERFNETIKDALANKKGIGLSIGPVNVRSSHVVTMWGAEFDENGDVSYIYMADNNDRWGVGCIRYQIVYVEGGTYTCYKTEIIGSDRPIPINRLVTLELGEEYWKQTNLEHHHHHH

SEQ ID NO: 591 - protein, 315 aa, synthetic construct
MANQEIRYSGDSEWANKKVWVYGITPAEEGAWLYSTYYLPWKKEYGWYDCNKRNPTADGMMCWAASASNLMHWWIAQNKRYIDLYGDRYKGPDKINFNGEQMFDVKEYIDPLDKPQESDIFQCFIDKSFADLSTKHEAGKGDEGINWFIHGIIPSYPAHGPTPVKLRYPYNPAGYFKDVFPRGDGVVLGGNNGDFKELGKERFNETIKDALANKKGIGLSIGPVNVRKSHVETMWGAEFDENGDVSYIYMADNNDRWGVGCIRLQIVYVEGATYTCYKTEIIPSDRPIPINRLVTVELGEEYWKQTNLEHHHHHH

SEQ ID NO: 592 - protein, 315 aa, synthetic construct
MANQEIRYSSDSEWANKKVWVYGITPPEEGAWFYSTYYLPWKKEYGWYDCNKRNPTADGMMCWAASASNLLHWWIAQNKEYIDLYGDKYKGPDKINFNGEQMFDVKEYIDPLDKPQESDIFQCFIDKSFADLSTKHEAGKGDAGINWFIHGIIPSSPAHGPTPVKLRYPYNPAGYFKDVFPRGDGVVLLGNNGDFKELGKERFNETIKDALANKKGIGLSIGPVNVRSSHVVTIWGAEFDENGDVSYIYMADNNDRWGVGCIRYQIVYEEGGTYTCYKTEIIPSDRPIPINRLVTLELGEEYWKQTNLEHHHHHH

SEQ ID NO: 593 - protein, 315 aa, synthetic construct
MANQEIRYSSDSEWANKKVWVYGITPPEEGAWKYSTYYLPWKKEYGWYDCNKRNPTADGMMCWAATASNLLHWWIAQNKEYIDLYGDKYKGPDKINFNGEQMFDVKEYIDPLDKPQESDIFQCFIDKSFADLSTKHEAGYGDEGINWFIHGIIPSSPAHGPTPVKLRKPYNPAGYFKDVFPRGDGVKLLSNNGDFKELGKERFNETIKDALKNKKGIGLSIGPVNVRSGHVVTMWGAEFDENGDVSYIYIADNNDRWGVGCIRYQIVYEEGGTYTCYKTEIINEDRPIPINRLVTLELGEEYWKQTNLEHHHHHH

SEQ ID NO: 594 - protein, 315 aa, synthetic construct
MANQEIRYSKNENPNVTIKWVHGIGEPTQAEKEKIEFYWYETNTTKFFNNRKVTHLGDSNQCWAKTASNMLHWWFEQNKENINKYIEKKNITGKINFNGEQMFDVKEGIDDNQEKEKSYIANTFRTKKAHNLSTKHKGDYIISGLAWYLYGLNNFKNAHGPTPVKKKPKFYGPALFKDVFNRGDGNTPIKEETDFKEYTKKEFEDILKEALDSKKAIGINIYGSNVGYGHAITLWGAAFDEDNNIIAIYVVDNNFKFENRIFPYGIWYEKEGRPYLFNYEINSFVKNRYVGEITTLDKGEAQWQETNLEHHHHHH

SEQ ID NO: 595 - protein, 315 aa, synthetic construct
MANQEIRYSKNENPNVTIKWVHGIGEPTQAEKEKIEFYWYETNTTKFFNNRKVTHLGDSNQCWAKTASNMLHWWFVQNKENINKYIEKKNITGKINFNGEQMFDVKEGIDDNQEKEKSYIANTFRTKKAHNLSTKHKGDYIINGLAWYLYGLNNFKNAHGPTPVKKKPKFYGPALFKDVFNRGDGNTPIIEETDFKEYTKKEFEDTLSEALDSKKAIGINIYGSNVDYGHAITLWGAAFDEDENIIAIYVVDNNFKFENRIFPYGIWYEKEGRPYLFNYEINSFVKNRYVGEITTLDKGEAQWQETNLEHHHHHH

SEQ ID NO: 596 - protein, 315 aa, synthetic construct
MANQEIRYSKNENPNVTIKWVHGIGEPTQAEKEKIEFWWYETTTTKFFNNRKVDHLGDGNQCWAKTDSNMLHWWFVQNEENINQYIAKKNITGKINFNGEQMFDVKEGIDDNQEKEKSYIANTFRTKKAHNLSTKHKGDYIINGLSWYLYGLNNFKIAHGPTPVKKKPKFYGPALFKDVFSRGDGNTPIIVETDFKEYTKKEFEDTLSAALDSKKAIGINIYGSNVDYQHAITLWGAAFDEEENIIAIYVVDNNFKFENRIFPYGIWYQKEGRPYLFNYEINSFVKNRYVGEVTTLDKGEAQWQETNLEHHHHHH

SEQ ID NO: 597 - protein, 315 aa, synthetic construct
MANQEIRYSKNENPNVTIKWVHGIGEPTQAEKEKIEFWWYETTTTKFFNNRKVDHLGDGNQCWAKTDSNMLHWWFVQNEENINQYIEKKNITGKINFNGEQMFDVKEGIDDNQEPEKSYIANTFRTKKAHNLSTKHKGDYIINGLSWYLYGLNNFKNAHGPTPVKKKPKFYGPALFKDVFNRGDGNTPIIVETDFKEYTKKEFEDTLSAALDSKKAVGINIYGSNVDYQHAITLWGAAFDEEENIIAIYVVDNNFKFENRIFPYGIWYQKEGRPYLFNYEINSFVKNRYVGEITTLDKGEAQWQETNLEHHHHHH

SEQ ID NO: 598 - protein, 315 aa, synthetic construct
MANQEIRYSKNENPNVTIKWVHGIGEPTQSEKEKIEFWWYETTTTKFFNNRKVDPLGDGNQCWAKTDSNMLHWWFVQNEENINQYIEKKNITGKINFNGEQMFDVKEGIDDNQEPEKSYIANTFRTKKAHNLSTKHKGDYIINGLSWYLYGLNNFKNAHGPTPVKKKPKFYGPALFKDVFNRGDGNTPIIVETDFKEYTKKEFEDTLSAALDSKKAIGINIYGSNVDYQHAITLWGAAFDEEENIIAIYVVDNNFKFENRIFPYGIWYEKEGRPYLFNYEINSFVKNRYVGEITTLDKGEAQWQETNLEHHHHHH

SEQ ID NO: 599 - protein, 315 aa, synthetic construct
MANQEIRYSKNENPNVTIKWVHGIGEPTQAEKEKIEFWWYETTTTKFFNNRKVDHLGDGNQCWAKTDSNMLHWWFVQNEENINQYIAKKNITGKINFNGEQMFDVKEGIDDNQEKEKSYIANTFRTKKAHNLSTKHKGDYIINGLSWYLYGLNNFKIAHGPTPVKKKPKFYGPALFKDVFNRGDGNTPIIVETDFKEYTKKEFEDTLSAALDSKKAIGINIYGSNVDYQHAITLWGAAFDEEENIIAIYVVDNNFKFENRIFPYGIWYQKEGRPYLFNYEINSFVKNRYVGEVITLDKGEAQWQETNLEHHHHHH

SEQ ID NO: 600 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIERYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLKEISDLIKQELTEGKALGLSHTYANVRINHVINLWGADFDSEGNLEAIYVTDSDSNASIGMKKYYVGVNSAGKVAISAKEIEGDNIGAQVLGLFTLSTGQDIWEQTNLEHHHHHH

SEQ ID NO: 601 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNSEGNLEAIYVTDSDSNASIGMKKYYVGVNSAGKVAISAKEIEGDNIGAQVLGLFTLSTGQDIWEQTNLEHHHHHH

SEQ ID NO: 602 - protein, 315 aa, synthetic construct
MANQEIRYSEETPKTITSVWTKGVTPPTDFIQNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWEQTNLEHHHHHH

SEQ ID NO: 603 - protein, 315 aa, synthetic construct
MANQEIRYSEETPKTITSVWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQTKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWEQTNLEHHHHHH

SEQ ID NO: 604 - protein, 315 aa, synthetic construct
MANQEIRYSEDTPSHITSVWTKGVTPPTQFIQNEDVLHAPYIANQGWYDITKTFNGKDDLLCGAATAGNMLHWWFDQNKEQIEAYLKKYPEKQKINFNGEQMFDVKEAIDTKDSQTDSALFNYFKDKAFPYLSTKHLGVFPDHVIDMFINGYRLSLTNHGPTPVKNQTKDPRGGIFDAVFTRGDQSKLLTARHDFKEKTLKEISQLIKQELTEGKALGLSHTYANVRINHVINLWGADFNAEGNLEAIYVTDSDSNASIGMKKYYVGVNAAGKVAISAKEIEGDNIGAQVLGLFTLSTGQDIWQQTNLEHHHHHH

SEQ ID NO: 605 - protein, 315 aa, synthetic construct
MANQEIRYSEETPKTITSIWTKGVTPPTDFIKNEDVLHAPYIANQGWYDITKTFNGKDDLLCGAATAGNMLHWWFDQNKEEIENYLKKHPEKQKINFNGEQMFDVKEAIDTKDSQTDSKLFEYFKDKAFPYLSTKHLGVFPDHVIDMFINGYRLSLTNHGPTPVKRGTKDPRGGIFDAVFTRGDQSKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWNQTNLEHHHHHH

SEQ ID NO: 606 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWNQTNLEHHHHHH

SEQ ID NO: 607 - protein, 315 aa, synthetic construct
MANQEIRYSEETPKTITSVWTKGVTPPTDFIQNEDVLHAPYIANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWNQTNLEHHHHHH

SEQ ID NO: 608 - protein, 315 aa, synthetic construct
MANQEIRYSEETPKTITSIWTKGVTPPTDFIKNEDVLHAPYVANQGWYDITKTFNGKDDLLCGAATAGNMLHWWFDQNKEEIENYLKKHPEKQKINFNGEQMFDVKEAIDTKDSQTDSKLFEYFKDKAFPYLSTKHLGVFPDHVIDMFINGYRLSLTNHGPTPVKRGTKDPRGGIFDAVFTRGDQTKLLTERHDFKEKTLNEISDLIKQELTEGKALGLSHTYANVRINHVINLWGADFNSEGNLEAIYVTDSDSNASIGMKKYYVGVNAAGKVAISAKEIEDDNIGAQVLGLFTLSTGKDIWEQTNLEHHHHHH

SEQ ID NO: 609 - protein, 315 aa, synthetic construct
MANQEIRYSEETPKTITSVWTKGVTPPTDFIKNEDVFHAPYVANQGWYDITKTFNGKDDLLCGAATAGNMLHWWFDQNKEEIENYLKKHPEKQKINFNGEQMFDVKEAIDTKDSQTDSALFNYFKDKAFPYLSTKHLGVFPDHVIDMFINGYRLSLTNHGPTPVKDGTKDPRGGIFDAVFTRGDQTKLLTARHDFKEKTLNEISDLIKQELTEGKALGLSHTYANVRINHVINLWGADFDSEGNLEAIYVTDSDSNASIGMKKYYVGVNAAGKVAISAKEIEDDNIGAQVLGLFTLSTGQDIWEQTNLEHHHHHH

SEQ ID NO: 610 - protein, 315 aa, synthetic construct
MANQEIRYSEETPKTITSVWTKGVTPPTDFIKNEDVLHAPYVANQGWYDITKTFNGKDDLLCGAATAGNMLHWWFDQNKEEIERYLKKHPEKQKINFNGEQMFDVKEAIDTKDSQTDSKLFEYFKDKAFPYLSTKHLGVFPDHVIDMFINGYRLSLTNHGPTPVKRGTKDPRGGIFDAVFTRGDQSKLLTSRHDFKEKTLNEISDLIKQELQEGKALGLSHTYANVRINHVINLWGADFDSEGNLEAIYVTDSDSNASIGMKKYYVGVNSAGKVAISAKEIEDDNIGAQVLGLFTLSTGKDIWEQTNLEHHHHHH

SEQ ID NO: 611 - protein, 315 aa, synthetic construct
MANQEIRYSKAKPKVITSVWTKGVTPPTQFTYNEDVFHAPYLPNQGWYDITKTFNGKDDLLCGAATAGNMLHWWFDQNKEQIERYLKEHPEKQKINFNGEQMFDVKEAIDTKDSQTNSKLFNYFKDKAFPYLSTKHLGVFPDHVIDMFINGYRLSLTNHGPTPVKEQNKDPRGGIFDDVFTRGDQSKLLTSRHDFKEKTLKEISDLIKQELKEGKALGLSHTYANVRINHVINLWGADFDAEGNLVAIYVTDSDSNASIGMKKYYVGVNSAGKVAISAKEIEDDNIGAQVLGLFTLSTGKDIWEKTNLEHHHHHH

SEQ ID NO: 612 - protein, 315 aa, synthetic construct
MANQEIRYSEEDGKTITSVWTKGVTPPTDFQKNEDVYHAPYVANQGWYDITKTFNGKDDLLCGAATAGNMLHWWFDQNKEEIERYLKKHPEKQKINFNGEQMFDVKEAIDTKDSQTDSALFEYFKDKAFPYLSTKHLGVFPDHVIDMFINGYRLSLTNHGPTPVKDGTKDPRGGIFDAVFTRGDQTKLLTERHDFKEKTLNEISDLIKQELQEGKALGLSHTYANVRINHVINLWGADFDSEGNLEAIYVTDSDSNASIGMKKYYVGVNSAGKVAISAKEIEDDNIGAQVLGLFTLSTGKDIWEQTNLEHHHHHH

SEQ ID NO: 613 - protein, 315 aa, synthetic construct
MANQEIRYSEETPSTITSIWTKGVTPPTQFIQNEDVLHAPYIANQGWYDITKTFNGKDDLLCGAATAGNMLHWWFDQNKTEIENYLTKHPEKQKINFNGEQMFDVKEAIDTKDSQTDSALFSYFKDKAFPYLSTKHLGVFPDHVIDMFINGYRLSLTNHGPTPVKRGTKDPRGGIFDAVFTRGDQTKLLTARHDFKEKTLNEISDLIKQELTEGKALGLSHTYANVRINHVINLWGADFNSEGNLEAIYVTDSDSNASIGMKKYYVGVNAAGKVAISAKEIEGDNIGAQVLGLFTLSTGQDIWQQTNLEHHHHHH

SEQ ID NO: 614 - protein, 315 aa, synthetic construct
MANQEIRYSEETPKTITSIWTKGVTPPTDFIKTEDVLHAPYVANQGWYDITKTFNGKDDLLCGAATAGNMLHWWFDQNKEEIENYLKKHPEKQKINFNGEQMFDVKEAIDTKDSQTDSALFEYFKDKAFPYLSTKHLGVFPDHVIDMFINGYRLSLTNHGPTPVKDGTKDPRGGIFDAVFTRGDQTKLLTERHDFKEKTLNEISDLIKQELTEGKALGLSHTYANVRINHVINLWGADFNSEGNLEAIYVTDSDSNASIGMKKYYVGVNAAGKVAISAKEIEDDNIGAQVLGLFTLSTGQDIWEQTNLEHHHHHH

SEQ ID NO: 615 - protein, 315 aa, synthetic construct
MANQEIRYSEETPKTITSVWTKGVTPPTDFIYNEDVLHAPYIANQGWYDITKTFNGKDDLLCGAATAGNMLHWWFDQNKEQIERYLKKHPEKQKINFNGEQMFDVKEAIDTKDSQTDSALFEYFKDKAFPYLSTKHLGVFPDHVIDMFINGYRLSLTNHGPTPVKRQTKDPRGGIFDAVFTRGDQSKLLTSRHDFKEKTLKEISDLIKQELTEGKALGLSHTYANVRINHVINLWGADFDAEGNLEAIYVTDSDSNASIGMKKYYVGVNSAGKVAISAKEIEGDNIGAQVLGLFTLSTGQDIWEQTNLEHHHHHH

SEQ ID NO: 616 - protein, 315 aa, synthetic construct
MANQEIRYSEETPSTITSVWTKGVTPPTQFIYNEDVFHAPYIANQGWYDITKTFNGKDDLLCGAATAGNMLHWWFDQNKEQIENYLKKHPEKQKINFNGEQMFDVKEAIDTKDSQTDSKLFNYFKDKAFPYLSTKHLGVFPDHVIDMFINGYRLSLTNHGPTPVKRQTKDPRGGIFDAVFTRGDQSKLLTSRHDFKEKTLNEISDLIKQELTEGKALGLSHTYANVRINHVINLWGADFDAEGNLEAIYVTDSDSNASIGMKKYYVGVNSAGKVAISAKEIEGDNIGAQVLGLFTLSTGQDIWQQTNLEHHHHHH

SEQ ID NO: 617 - protein, 315 aa, synthetic construct
MANQEIRYSKATPSHITSVWTKGVTPPEQFIQNEDVLHAPYIANQGWYDITKTFNGKDDLLCGAATAGNMLHWWFDQNKEQIENYLKKHPEKQKINFNGEQMFDVKEAIDTKDSQTNSALFSYFKDKAFPYLSTKHLGVFPDHVIDMFINGYRLSLTNHGPTPVKEQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 618 - protein, 315 aa, synthetic construct
MANQEIRYSEATPSHITSVWTKGVTPPTQFIQNEDVLHAPYIANQGWYDITKTFNGKDDLLCGAATAGNMLHWWFDQNKTQIENYLKKHPEKQKINFNGEQMFDVKEAIDTKDSQTDSALFSYFKDKAFPYLSTKHLGVFPDHVIDMFINGYRLSLTNHGPTPVKRQTKDPRGGIFDAVFTRGDQSKLLTARHDFKEKTLNEISQLIKQELTEGKALGLSHTYANVRINHVINLWGADFNAEGNLEAIYVTDSDSNASIGMKKYYVGVNAAGKVAISAKEIEGDNIGAQVLGLFTLSTGQDIWQQTNLEHHHHHH

SEQ ID NO: 619 - protein, 315 aa, synthetic construct
MANQEIRYSEATPSHITSVWTKGVTPPTQFIQNEDVLHAPYIANQGWYDITKTFNGKDDLLCGAATAGNMLHWWFDQNKTQIENYLKKHPEKQKINFNGEQMFDVKEAIDTKDSQTDSALFSYFKDKAFPYLSTKHLGVFPDHVIDMFINGYRLSLTNHGPTPVKRQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNAAGKVAISAKEIEGDNIGAQVLGLFTLSTGQDIWQQTNLEHHHHHH

SEQ ID NO: 620 - protein, 315 aa, synthetic construct
MANQEIRYSEATPSHITSVWTKGVTPPTQFIQNEDVLHAPYIANQGWYDITKTFNGKDDLLCGAATAGNMLHWWFDQNKEQIENYLKKHPEKQKINFNGEQMFDVKEAIDTKDSQTDSALFSYFKDKAFPYLSTKHLGVFPDHVIDMFINGYRLSLTNHGPTPVKRQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 621 - protein, 315 aa, synthetic construct
MANQEIRYSEETPSTITSVWTKGVTPPTQFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 622 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 623 - protein, 315 aa, synthetic construct
MANQEIRYSEATPSHITSVWTKGVTPPTQFIQNEDVLHAPYIANQGWYDITKTFNGKDDLLCGAATAGNMLHWWFDQNKTQIENYLKKHPEKQKINFNGEQMFDVKEAIDTKDSQTDSALFSYFKDKAFPYLSTKHLGVFPDHVIDMFINGYRLSLTNHGPTPVKRQTKDPRGGIFDAVFTRGDQSKLLTARHDFKEKTLNEISQLIKQELTEGKALGLSHTYANVRINHVINLWGADFNAEGNLEAIYVTDSDSNASIGMKKYYVGVNAAGHVAISAKEIEGDNIGAQVLGLFTLSTGQDIWQQTNLEHHHHHH

SEQ ID NO: 624 - protein, 315 aa, synthetic construct
MANQEIRYSKATPSHITSVWTKGVTPPEQFIYNEDVLHAPYIANQGWYDITKTFNGKDDLLCGAATAGNMLHWWFDQNKEQIENYLKKHPEKQKINFNGEQMFDVKEAIDTKDSQTNSALFSYFKDKAFPYLSTKHLGVFPDHVIDMFINGYRLSLTNHGPTPVKEQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 625 - protein, 315 aa, synthetic construct
MANQEIRYSEATPSHITSVWTKGVTPPEQFIQNEDVLHAPYIANQGWYDITKTFNGKDDLLCGAATAGNMLHWWFDQNKEQIEAYLKKHPEKQKINFNGEQMFDVKEAIDTKDSQTDSALFNYFKDKAFPYLSTKHLGVFPDHVIDMFINGYRLSLTNHGPTPVKEQTKDPRGGIFDAVFTRGDQSKLLTSRHDFKEKTLKEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 626 - protein, 315 aa, synthetic construct
MANQEIRYSEETPSTITSVWTKGVTPPTQFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNAAGKVAISAKEIEGDNIGAQVLGLFTLSTGQDIWNQTNLEHHHHHH

SEQ ID NO: 627 - protein, 315 aa, synthetic construct
MANQEIRYSEATPSHITSVWTKGVTPPTQFIQNEDVLHAPYIANQGWYDITKTFNGKDDLLCGAATAGNMLHWWFDQNKEQIENYLKKHPEKQKINFNGEQMFDVKEAIDTKDSQTDSALFSYFKDKAFPYLSTKHLGVFPDHVIDMFINGYRLSLTNHGPTPVKEQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 628 - protein, 315 aa, synthetic construct
MANQEIRYSEETPSTITSVWTKGVTPPTQFIQNEDVLHAPYIANQGWYDITKTFNGKDDLLCGAATAGNMLHWWFDQNKEQIENYLKKHPEKQKINFNGEQMFDVKEAIDTKDSQTDSALFSYFKDKAFPYLSTKHLGVFPDHVIDMFINGYRLSLTNHGPTPVKRQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 629 - protein, 315 aa, synthetic construct
MANQEIRYSEETPKTITSVWTKGVTPPTDFIYNEDVLHAPYIANQGWYDITKTFNGKDDLLCGAATAGNMLHWWFDQNKEQIERYLKKHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLNEISDLIKQELTEGKALGLSHTYANVRINHVINLWGADFDAEGNLEAIYVTDSDSNASIGMKKYYVGVNSAGKVAISAKEIEGDNIGAQVLGLFTLSTGKDIWEQTNLEHHHHHH

SEQ ID NO: 630 - protein, 315 aa, synthetic construct
MANQEIRYSEETPKTITSVWTKGVTPPTDFIYNEDVLHAPYIANQGWYDITKTFNGKDDLLCGAATAGNMLHWWFDQNKEQIERYLKKHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLKEISDLIKQELTEGKALGLSHTYANVRINHVINLWGADFDAEGNLEAIYVTDSDSNASIGMKKYYVGVNSAGKVAISAKEIEGDNIGAQVLGLFTLSTGKDIWEQTNLEHHHHHH

SEQ ID NO: 631 - protein, 315 aa, synthetic construct
MANQEIRYSKATPSTITSVWTKGVTPPENFIYNEDVLHAPYLANQGWYDITKTFNGKDDLLCGAATAGNMLHWWFDQNKEQIERYLKKHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 632 - protein, 315 aa, synthetic construct
MANQEIRYSKATPSTITSVWTKGVTPPENFIYNEDVLHAPYLANQGWYDITKTFNGKDDLLCGAATAGNMLHWWFDQNKEQIERYLKEHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 633 - protein, 315 aa, synthetic construct
MANQEIRYSKATPKVITSVWTKGVTPPEDFTYNEDVFHAPYLPNQGWYDITKTFNGKDDLLCGAATAGNMLHWWFDQNKEQIERYLKEHPEKQKINFNGEQMFDVKEAIDTKDSQTNSKLFEYFKDKAFPYLSTKHLGVFPDHVIDMFINGYRLSLTNHGPTPVKEQNKDPRGGIFDAVFTRGDQSKLLTSRHDFKEKTLKEISDLIKQELKEGKALGLSHTYANVRINHVINLWGADFDAEGNLEAIYVTDSDSNASIGMKKYYVGVNSAGKVAISAKEIEGDNIGAQVLGLFTLSTGKDIWEQTNLEHHHHHH

SEQ ID NO: 634 - protein, 315 aa, synthetic construct
MANQEIRYSKATPSHITSVWTKGVTPPENFIYNEDVLHAPYLPNQGWYDITKTFNGKDDLLCGAATAGNMLHWWFDQNKEQIERYLKEHPEKQKINFNGEQMFDVKEAIDTKDSQTNSKLFEYFKDKAFPYLSTKHLGVFPDHVIDMFINGYRLSLTNHGPTPVKEQNKDPRGGIFDAVFTRGDQSKLLTSRHDFKEKTLNEISQLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWQQTNLEHHHHHH

SEQ ID NO: 635 - protein, 315 aa, synthetic construct
MANQEIRYSEETPKTITSVWTKGVTPPTDFIKNEDVFHAPYVANQGWYDITKTFNGKDDLLCGAATAGNMLHWWFDQNKEEIERYLKKHPEKQKINFNGEQMFDVKEAIDTKDSQTNSKLFEYFKDKAFPYLSTKHLGVFPDHVIDMFINGYRLSLTNHGPTPVKRGTKDPRGGIFDAVFTRGDQSKLLTSRHDFKEKTLKEISDLIKQELQEGKALGLSHTYANVRINHVINLWGADFDSEGNLEAIYVTDSDSNASIGMKKYYVGVNSAGKVAISAKEIEDDNIGAQVLGLFTLSTGKDIWEQTNLEHHHHHH

SEQ ID NO: 636 - protein, 315 aa, synthetic construct
MANQEIRYSKATPKTITSVWTKGVTPPENFIYNEDVLHAPYLANQGWYDITKTFNGKDDLLCGAATAGNMLHWWFDQNKEQIERYLKEHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLNEISDLIKQELTEGKALGLSHTYANVRINHVINLWGADFDAEGNLEAIYVTDSDSNASIGMKKYYVGVNSAGKVAISAKEIEGDNIGAQVLGLFTLSTGKDIWEQTNLEHHHHHH

SEQ ID NO: 637 - protein, 315 aa, synthetic construct
MANQEIRYSKAKPKVITSVWTKGVTPPTQFTKNEDVFHAPYLANQGWYDITKTFNGKDDLLCGAATAGNMLHWWFDQNKEQIERYLKKHPEKQKINFNGEQMFDVKEAIDTKDSQTNSKLFNYFKDKAFPYLSTKHLGVFPDHVIDMFINGYRLSLTNHGPTPVKEQNKDPRGGIFDDVFTRGDQSKLLTSRHDFKEKTLKEISDLIKQELKEGKALGLSHTYANVRINHVINLWGADFDAEGNLVAIYVTDSDSNASIGMKKYYVGVNSAGKVAISAKEIEDDNIGAQVLGLFTLSTGKDIWEKTNLEHHHHHH

SEQ ID NO: 638 - protein, 315 aa, synthetic construct
MANQEIRYSKAKPKVITSVWTKGVTPPTQFTKNEDVFHAPYLANQGWYDITKTFNGKDDLLCGAATAGNMLHWWFDQNKEQIERYLKKHPEKQKINFNGEQMFDVKEAIDTKDSQTNSKLFNYFKEKAFPYLSTKHLGVFPDHVIDMFINGYRLSLTNHGPTPVKEQNKDPRGGIFDDVFTRGDQSKLLTSRHDFKEKTLKEISDLIKQELKEGKALGLSHTYANVRINHVINLWGADFDAEGNLIAIYVTDSDSNASIGMKKYYVGVNSAGKVAISAKEIEDDNIGAQVLGLFTLSTGKDIWEKTNLEHHHHHH

SEQ ID NO: 639 - protein, 315 aa, synthetic construct
MANQEIRYSEETPKTITSVWTKGVTPPTNFIYNEDVLHAPYIANQGWYDITKTFNGKDDLLCGAATAGNMLHWWFDQNKEQIERYLKKHPEKQKINFNGEQMFDVKEAIDTKDSQTNSKLFEYFKDKAFPYLSTKHLGVFPDHVIDMFINGYRLSLTNHGPTPVKRQTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWEQTNLEHHHHHH

SEQ ID NO: 640 - protein, 315 aa, synthetic construct
MANQEIRYSKATPSTITSVWTKGVTPPEQFIYNEDVLHAPYIANQGWYDITKTFNGKDDLLCGAATAGNMLHWWFDQNKEQIERYLKKHPEKQKINFNGEQMFDVKEAIDTKDSQTNSKLFEYFKDKAFPYLSTKHLGVFPDHVIDMFINGYRLSLTNHGPTPVKEQTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWEQTNLEHHHHHH

SEQ ID NO: 641 - protein, 315 aa, synthetic construct
MANQEIRYSEETPKTITSVWTKGVTPPTDFIYNEDVLHAPYIANQGWYDITKTFNGKDDLLCGAATAGNMLHWWFDQNKEQIERYLKKHPEKQKINFNGEQMFDVKEAIDTKDSQTDSKLFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWEQTNLEHHHHHH

SEQ ID NO: 642 - protein, 315 aa, synthetic construct
MANQEIRYSEETPKTITSVWTKGVTPPTDFIYNEDVLHAPYIANQGWYDITKTFNGKDDLLCGAATAGNMLHWWFDQNKEQIERYLKKHPEKQKINFNGEQMFDVKEAIDTKDSQTDSKLFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNSEGNLEAIYVTDSDSNASIGMKKYYVGVNSAGKVAISAKEIEGDNIGAQVLGLFTLSTGKDIWEQTNLEHHHHHH

SEQ ID NO: 643 - protein, 315 aa, synthetic construct
MRNQTTTYSEVTPSHITSVWTKGVTPPEQFIQGEDVFHAPYIANQGWYDITKTFNGKDDLLCGAATAGNMLHWWFDQNKEQIENYLKKHPEKQKIMFNNEEMFDLREAINTKDSQTDSALFSYFKDKAFPNLSARRLGVMPDHVLDMFINGYYLNVGNTDKTDVNRGTKDLRGGIFDAVFTRGDQSKLLTARHDLKNKTLKEISDLIKQELTEGKALALSHTYANVRINHVINLWGADFDAEGNLEAIYVTDSDSNASIGMKKYYVGVNSAGKVAISAKKIEGDNIGAQVLGLFTLSTGQDIWQQTNLEHHHHHH

SEQ ID NO: 644 - protein, 315 aa, synthetic construct
MRNQTTTYSEVTPSHITSVWTKGVTPPEQFIQGEDVFHAPYIANQGWYDITKTFNGKDDLLCGAATAGNMLHWWFDQNKEQIENYLKKHPEKQKINFNNEEMFDVREAINTKDSQTDSALFSYFKDKAFPYLSAKHLGVFPDHVIDMFINGYRLSLTNHDKTDVNRGTKDPRGGIFDAVFTRGDQSKLLTARHDFKNKTLKEISDLIKQELTEGKALGLSHTYANVRINHVINLWGADFDAEGNLEAIYVTDSDSNASIGMKKYYVGVNSAGKVAISAKKIEGDNIGAQVLGLFTLSTGQDIWQQTNLEHHHHHH

SEQ ID NO: 645 - protein, 315 aa, synthetic construct
MANQEIRYSEETPSTVTSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 646 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIKNYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 647 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKNSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 648 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDHQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 649 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQLDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 650 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKNLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 651 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKKELTEGKALGLSHTYANVRINHVINLWGADFNAEGNLEAIYVTDSDSNASIGMKKYYVGVNSAGKVAISAKEIEGDNIGAQVLGLFTLSTGQDIWNQTNLEHHHHHH

SEQ ID NO: 652 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNANGNLEAIYVTDSDSNASIGMKKYYVGVNSAGKVAISAKEIEGDNIGAQVLGLFTLSTGQDIWNQTNLEHHHHHH

SEQ ID NO: 653 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYFVGVNSAGKVAISAKEIEGDNIGAQVLGLFTLSTGQDIWNQTNLEHHHHHH

SEQ ID NO: 654 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIKGDNIGAQVLGLFTLSTGQDIWNQTNLEHHHHHH

SEQ ID NO: 655 - protein, 315 aa, synthetic construct
MANQEIRYSEETPSTITSVWTKGVTPPTDFIQNEDVLHAPYIANQGWYDITKTFNGKDDLLCGAATAGNMLHWWFDQNKEQIENYLKKHPEKQKINFNGEQMFDVKEAIDTKDSQTDSALFEYFKDKAFPYLSTKHLGVFPDHVIDMFINGYRLSLTNHGPTPVKRGTKDPRGGIFDAVFTRGDQSKLLTSRHDFKEKTLNEISDLIKQELTEGKALGLSHTYANVRINHVINLWGADFNAEGNLEAIYVTDSDSNASIGMKKYYVGVNSAGKVAISAKEIEGDNIGAQVLGLFTLSTGQDSWNQTNLEHHHHHH

SEQ ID NO: 656 - protein, 315 aa, synthetic construct
MANQEIRYSEETPSTVTSVWTKGVTPPTDFIQNEDVLHAPYIANQGWYDITKTFNGKDDLLCGAATAGNMLHWWFDQNKEQIKNYLKKHPEKQKINFNGEQMFDVKEAIDTKNHQLDSALFEYFKDKAFPYLSTKHLGVFPDHVIDMFINGYRLSLTNHGPTPVKRGTKDPRGGIFDAVFTRGDQSKLLTSRHDFKEKNLNEISDLIKKELTEGKALGLSHTYANVRINHVINLWGADFNANGNLEAIYVTDSDSNASIGMKKYFVGVNSAGKVAISAKEIKGDNIGAQVLGLFTLSTGQDSWNQTNLEHHHHHH

SEQ ID NO: 657 - protein, 315 aa, synthetic construct
MANQEIRYSEVTPYHITSVWTKGVTPPANFTQGEDVFHAPYVANQGWYDITKTFNGKDDLLCGAATAGNMLHWWFDQNKDQIERYLEEHPEKQKINFNGEQMFDVKEAIDTKDSQTDSKLFEYFKEKAFPYLSTKHLGVFPDHVIDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYYVGVNSAGKVAISAKEIEEDNIGAQVLGLFTLSTGQDIWNQTNLEHHHHHH

SEQ ID NO: 658 - protein, 307 aa, synthetic construct
MQITTVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNGGLNDISTIIKQELQSGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 659 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDDVFGKGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 660 - protein, 307 aa, synthetic construct
MQITSVWTKGVTPLTPEQFRYNNEDVIHAPYLAHQGWYDITKAFDGKDNLLCGAATAGNMLHWWFEQNKTEIEAYLSKYGDTQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKEIWQKLSLEHHHHHH

SEQ ID NO: 661 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKYPDKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKEIWQKLSLEHHHHHH

SEQ ID NO: 662 - protein, 307 aa, synthetic construct
MQITSVWTYGVKPLTPEQFRYNNEDVIHAPYLEHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 663 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDADEKIGMKKYFVGINAHGHVAISAKKIEGENIGAQVLGLFTLSSGKDIWQKLSLEHHHHHH

SEQ ID NO: 664 - protein, 307 aa, synthetic construct
MQITSVWTKGVTPLTPEQFRYNNEDVIHAPYLAHQGWYDITKAFDRGDNLLCGAATAGNMLHWWFDQNKTEIEAYLSKHPEKQKIIFNNQELFDLKAAIDTKDSQTNSQLFNYFRDKAFPNLSARQGGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDADEKIGMKKYFVGINAHGHVAISAKKIEGENIGAQVLGLFTLSSGKDIWQKLSLEHHHHHH

SEQ ID NO: 665 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYYVGINAHGHVAISAYKIEGENIGAQVLGLFTLSSGKDIWQKLSLEHHHHHH

SEQ ID NO: 666 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARYDLYNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 667 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLRAAINSKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 668 - protein, 307 aa, synthetic construct
MQITTVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAISTKDSQTNSQLFNYFRDKAFPNLSARQLGVMPDLVLDMFINGYYLNVFKTQSTDVNRPYQDKDKRGGIFDDVFTRGDQTTLLTARHDLKNGGLNDISTIIKQELTNGRALALSHTYANVSISHVINLWGADFNAEGNLEAIYVTDSDANARIGMKKYGVGINAHGHVAISAKKIEGENIGAQVLGLFTLSSGKDIWQKLSLEHHHHHH

SEQ ID NO: 669 - protein, 307 aa, synthetic construct
MQITSVWTKGVKPLTPEQFRYNNEDVIHAPYLAHQGWYDITKAFDGKDNLLCGAATAGNMLHWWFDQNKTEIEAYLSKHPEKQKIIFNNQELFDLRAAIDTKDSQTNSQLFNYFRDKAFPNLSARQLGVMPDLVLDMFINGYYLNVFKTQSTDVNRPYQDKDKRGGIFDDVFTRGDQTTLLTARHDLKNGGLNDISTIIKQELTEGRALALSHTYANVSISHVINLWGADFNAEGNLEAIYVTDSDANASIGMKKYKVGINAHGHVAISAKKIEGENIGAQVLGLFTLSSGKDIWQKLSLEHHHHHH

SEQ ID NO: 670 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDKDKRGGIFDAVFNRGDQTTLLTARHDLKNKGLNDISTIIKQELSSGRALALSHTYANVSISHVINLWGADFNAEGNLEAIYVTDSDANSNIGMKKYKVGINAHGHVAISAKKIEGENIGAQVLGLFTLSSGKDIWQKLSLEHHHHHH

SEQ ID NO: 671 - protein, 307 aa, synthetic construct
MQITTVWTKGVTPLTPEQFRYNNEDVIHAPYLPHQGWYDITKAFDGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDRDKRGGIFDAVFNRGDQTTLLTARHDLKNKGLNDISTIIKQELSSGRALALSHTYANVSISHVINLWGADFNAEGNLEAIYVTDSDANASIGMKKYYVGINAHGHVAISAKKIEGENIGAQVLGLFTLSSGKDIWQKLSLEHHHHHH

SEQ ID NO: 672 - protein, 307 aa, synthetic construct
MQITSVWTKGVTPLTPEQFRYNNEDVIHAPYLPHQGWYDITKAFDGGDNLLCGAATAGNMLHWWFDQNKTEIEAYLSKYPEKQKIIFNNQELFDLRAAINSKDSQTNSQLFNYFRDKAFPNLSARQLGVMPDLVLDMFINGYYLNVFKTQSTDVNRPYQDPDKRGGIFDDVFKEGDQTTLLTARHDLKNGGLNDISTIIKQELQSGRALALSHTYANVSISHVINLWGADFNAEGNLEAIYVTDSDANQSIGMKKYKVGINAHGHVAISAKKIEGENIGAQVLGLFTLSSGKEIWQKLSLEHHHHHH

SEQ ID NO: 673 - protein, 307 aa, synthetic construct
MQITSVWTKGVIPLTPEQFRYNNEDVIHAPYLPHQGWYDITKAFDGGDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDRDKRGGIFDHVFGRGDQTTLLTARHDLKNGGLNDISTIIKQELQSGRALALSHTYANVSISHVINLWGADFNAEGNLEAIYVTDSDANSSIGMKKYYVGINAHGHVAISAKKIEGENIGAQVLGLFTLSSGKEIWQKLSLEHHHHHH

SEQ ID NO: 674 - protein, 307 aa, synthetic construct
MQITTVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNGGLEDISTIIKQELKNGRALALSHTYANVSISHVINLWGADFNAEGNLSAIYVTDSDANASIGMKKYFVGINAHGHVAISAKKIEGENIGAQVLGLFTLSSGKDIWQKLSLEHHHHHH

SEQ ID NO: 675 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLKEISDIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 676 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLNEISQIIKQELSSGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 677 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLKEISDIIKQELQSGRALALSHTYANVSISHVINLWGADFNSEGNLIAIYVTDSDANASIGMKKYFVGINAHGHVAISAKKIEGENIGAQVLGLFTLSSGKDIWQKLSLEHHHHHH

SEQ ID NO: 678 - protein, 307 aa, synthetic construct
MQITTVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNGTLNEISQIIKQELQSGRALALSHTYANVSISHVINLWGADFNAEGNLIAIYVTDSDANASIGMKKYFVGINAHGHVAISAKKIEGENIGAQVLGLFTLSSGKDIWQKLSLEHHHHHH

SEQ ID NO: 679 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRDYDDKDKRGGIFDDVFGKGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 680 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPEDDKDKRGGIFDHVFTRGDQSTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 681 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPPDDKDKRGGIFDHVFNRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 682 - protein, 307 aa, synthetic construct
MQITSVWTKGVTPLTPEQFRYNNEDVIHAPYLAHQGWYDITKAFDGKDNLLCGAATAGNMLHWWFDQNKEEIEAYLKKYGETQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 683 - protein, 307 aa, synthetic construct
MQITSVWTKGVTPLTPEQFRYNNEDVIHAPYLAHQGWYDITKAFDGKDNLLCGAATAGNMLHWWFDQNKEEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGQDIWQQLSLEHHHHHH

SEQ ID NO: 684 - protein, 307 aa, synthetic construct
MQITSVWTKGVTPLTPEQFRYNNEDVIHAPYLAHQGWYDITKAFDGKDNLLCGAATAGNMLHWWFDQNKEEIEAYLKKYPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKEIWQKLSLEHHHHHH

SEQ ID NO: 685 - protein, 307 aa, synthetic construct
MQITSVWTKGVTPLTPEQFRYNNEDVIHAPYLAHQGWYDITKAFDGKDNLLCGAATAGNMLHWWFDQNKEEIENYLKKYPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGQEIWEQLSLEHHHHHH

SEQ ID NO: 686 - protein, 307 aa, synthetic construct
MQITSVWTKGVTPLTPEQFRYNNEDVIHAPYLAHQGWYDITKAFDGKDNLLCGAATAGNMLHWWFDQNKEEIDNYLKKYPDKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKEIWKKLSLEHHHHHH

SEQ ID NO: 687 - protein, 307 aa, synthetic construct
MQITSVWTYGVTPLTPEQFRYNNYEVIHAPYKEGQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 688 - protein, 307 aa, synthetic construct
MQITSVWTKGVTPLTPEQFTNNNEDVIHAPYKANQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 689 - protein, 307 aa, synthetic construct
MQITSVWTKGVTPLTPEQFRYNNYDVIHAPYKPNQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 690 - protein, 307 aa, synthetic construct
MQITSVWTKGVTPLTPDQFTNQGEDVIHAPYTPNQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 691 - protein, 307 aa, synthetic construct
MQITSVWTKGVTPLTMDQFRNYNYDVIHAPYKPGQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 692 - protein, 307 aa, synthetic construct
MQITSVWTKGVTPLTPEQFRYNNEDVIHAPYLAHQGWYDITKAFDGGDGLLCGAATAGNMLHWWFDQNKTEIEAYLSKHPEKQKIIFNNQELFDLKAAIDTKDSQTNSQLFNYFRDKAFPNLSARQKGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDAGNGIGMKKYFVGINAHGHVAISAKKIEGENIGAQVLGLFTLSSGKDIWQKLSLEHHHHHH

SEQ ID NO: 693 - protein, 307 aa, synthetic construct
MQITSVWTKGVTPLTPEQFRYNNEDVIHAPYLAHQGWYDITKLNDTGDGLLCGAATAGNMLHWWFDQNKTEIEAYLSKHPEKQKIIFNNQELFDLKAAIDTKDSQTNSQLFNYFRDKAFPNLSARQKGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSNAGNGIGMKKYFVGINAHGHVAISAKKIEGENIGAQVLGLFTLSSGKDIWQKLSLEHHHHHH

SEQ ID NO: 694 - protein, 307 aa, synthetic construct
MQITSVWTKGVTPLTPEQFRYNNEDVIHAPYLAHQGWYDITKTFNGKDDLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDADASIGMKKYFVGINAHGHVAISAKKIEGENIGAQVLGLFTLSSGKDIWQKLSLEHHHHHH

SEQ ID NO: 695 - protein, 307 aa, synthetic construct
MQITSVWTKGVTPLTPEQFRYNNEDVIHAPYLAHQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDADEKIGMKKYFVGINAHGHVAISAKKIEGENIGAQVLGLFTLSSGKDIWQKLSLEHHHHHH

SEQ ID NO: 696 - protein, 307 aa, synthetic construct
MQITSVWTKGVTPLTPEQFRYNNEDVIHAPYLAHQGWYDITKTMNGKDDLLCGAATAGNMLHWWFDQNKTEIEAYLSKHPEKQKIIFNNQELFDLKAAIDTKDSQTNSQLFNYFRDKAFPNLSARQRGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDARENIGMKKYFVGINAHGHVAISAKKIEGENIGAQVLGLFTLSSGKDIWQKLSLEHHHHHH

SEQ ID NO: 697 - protein, 307 aa, synthetic construct
MQITSVWTKGVTPLTPEQFRYNNEDVIHAPYLAHQGWYDITKTFNRGDNLLCGAATAGNMLHWWFDQNKTEIEAYLSKHPEKQKIIFNNQELFDLKAAIDTKDSQTNSQLFNYFRDKAFPNLSARQGGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDADEKIGMKKYFVGINAHGHVAISAKKIEGENIGAQVLGLFTLSSGKDIWQKLSLEHHHHHH

SEQ ID NO: 698 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYKVGYNKDGRVAISAYKIEGENIGAQVLGLFTLSSGKDIWQKLSLEHHHHHH

SEQ ID NO: 699 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYYVGKNASGHVAISAKKIEDENIGAQVLGLFTLSSGKDIWQKLSLEHHHHHH

SEQ ID NO: 700 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYYVGYNKSGRVAISAYKITDENIGAQVLGLFTLSSGKDIWQKLSLEHHHHHH

SEQ ID NO: 701 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTETTDLYGKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 702 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTNRYDLYDKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 703 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQYLFDLKAAIDTKDSQTNSQLFNYFRDKAFGNLSARQLGVMPDLVLDMFINGYYLNVNKTQSTDVNRPYQKPDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 704 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQYLFDLKAAIDTKDSQTNSQLFNYFRDKAFGNLSARQLGVMPDLVLDMFINGYKLKVNKTQSTDVNRPYQKPDNFGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 705 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQKLFDLKAAIDTKDSQTNSQLFNYFRDKAFPNLSARQLGVMPDLVLDMFINGYYLNVTKTQSTDVNRPYQTKDPRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 706 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFGNLSARQLGVMPDLVLDMFINGYYLNVGKTQSTDVNRPYQTRDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 707 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHGTANGGYSHVINLWGADFNAEGNLEAIYVTDSDANASIGMKKYFVGINAHGHVAISAKKIEGENKGAQVLGLFTLSSGKDIWQKLSLEHHHHHH

SEQ ID NO: 708 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYGNVRSSHVINLWGADFNAEGNLEAIYVTDSDANASIGMKKYFVGINAHGHVAISAKKIEGENVGAQVLGLFTLSSGKDIWQKLSLEHHHHHH

SEQ ID NO: 709 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTTGNVSYSHVINLWGADFNAEGNLEAIYVTDSDANASIGMKKYFVGINAHGHVAISAKKIEGENVGAQVLGLFTLSSGKDIWQKLSLEHHHHHH

SEQ ID NO: 710 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHKTGNGGSSHVINLWGADFNAEGNLEAIYVTDSDANASIGMKKYFVGINAHGHVAISAKKIEGEDVGAQVLGLFTLSSGKDIWQKLSLEHHHHHH

SEQ ID NO: 711 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKRAINDKDSQQNSELFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 712 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLREAINTKDSQTDSKLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 713 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLRKAINTKDSQTNSALFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 714 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLREAINTKDDQKDSKLFNYFREKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 715 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLRKAINTKDDQKESALFNYFRKKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 716 - protein, 307 aa, synthetic construct
MQITSVWTKGVTPLTPEQFRYNNEDVIHAPYLANQGWYDITKTFDGKDNLLCGAATAGNMLHWWFDQNKTEIEAYLSKHPEKQKIIFNNQELFDLKKAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDSNASIGMKKYFVGINAAGHVAISAKKIEGENIGAQVLGLFTLSSGKDIWQKLSLEHHHHHH

SEQ ID NO: 717 - protein, 307 aa, synthetic construct
MQITSVWTKGVTPLTPEQFRYNNEDVFHAPYLAHQGWYDITKAFDGKDNLLCGAATAGNMLHWWFDQNKTEIEAYLSKHPEKQKIIFNNQELFDLRAAINTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTLIKQELTEGRALALSHTYANVSISHVINLWGADFNAEGNLEAIYVTDSDANASIGMKKYFVGINASGHVAISAKKIEGENIGAQVLGLFTLSSGKDIWQKLSLEHHHHHH

SEQ ID NO: 718 - protein, 307 aa, synthetic construct
MQITSVWTKGVTPPTPEQFRYNNEDVIHAPYLAHQGWYDITKTFDGKDNLLCGAATAGNMLHWWFDQNKTEIEAYLSKHPEKQKIIFNNQELFDLKEAINTKDSQTNSQLFNYFRDKAFPNLSARQLGVMPDLVLDMFINGYYLNVFKTQSTDVNRPYQDKDKRGGIFDAVFTRGDQTKLLTARHDLKNKGLNEISTLIKQELTEGKALALSHTYANVSISHVINLWGADFNAEGNLEAIYVTDSDANASIGMKKYFVGINASGHVAISAKKIEGENIGAQVLGLFTLSTGKDIWQKLSLEHHHHHH

SEQ ID NO: 719 - protein, 307 aa, synthetic construct
MQITSVWTKGVTPLTPEQFRYNNEDVIHAPYLPHQGWYDITKAFDGKDNLLCGAATAGNMLHWWFDQNKTEIEAYLSKHPEKQKIIFNNQELFDLRAAINTKDSQTNSALFNYFRDKAFPNLSARQLGVMPDLVLDMFINGYYLNVFKTQSTDVNRPYQDKDKRGGIFDAVFTRGDQTTLLTARHDLKNKGLNDISTLIKQELTEGKALALSHTYANVSISHVINLWGADFNAEGNLEAIYVTDSDSDASIGMKKYYVGINASGHVAISAKKIEGENIGAQVLGLFTLSSGKDIWQKLSLEHHHHHH

SEQ ID NO: 720 - protein, 307 aa, synthetic construct
MQITSVWTKGVTPPTPEQFRYNNEDVIHAPYLAHQGWYDITKAFDGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDKDKRGGIFDAVFTRGDQTTLLTARHDLSNKGLNDISTIIKQELTEGRALALSHTYANVSISHVINLWGADFNAEGNLEAIYVTDSDSNASIGMKKYYVGINASGHVAISAKKIEGEVIGAQVLGLFTLSSGKEIWQKLSLEHHHHHH

SEQ ID NO: 721 - protein, 307 aa, synthetic construct
MQITSVWTKGVTPPTPEQFRNNNEDVFHAPYLANQGWYDITKTFNGKDDLLCGAATAGNMLHWWFDQNKTEIEAYLKKHPEKQKIIFNNQELFDLKKAIDTKDSQTNSQLFNYFRDKAFPNLSARQLGVMPDLVLDMFINGYYLNVTKTQSTDVNRPYQDKDKRGGIFDAVFTRGDQTTLLTSRHDLKNKGLNEISDLIKQELTEGKALALSHTYANVSINHVINLWGADFNAEGNLEAIYVTDSDSNASIGMKKYFVGVNASGKVAISAKKIEGENIGAQVLGLFTLSSGKDIWQKLSLEHHHHHH

SEQ ID NO: 722 - protein, 307 aa, synthetic construct
MQITSVWTKGVTPLTPEQFRYNNEDVFHAPYLAHQGWYDITKAFNGKDNLLCGAATAGNMLHWWFDQNKEEIEAYLKKHPEKQKIIFNNQELFDLRKAINTKDSQTNSQLFNYFRDKAFPNLSARQLGVMPDLVLDMFINGYYLNLNKTQSTDVNRPYQDKDKRGGIFDHVFTRGDQTTLLTARHDLKNKTLNDISQLIKQELQEGKALALSHTYANVSISHVINLWGADFNAEGNLEAIYVTDSDSDASIGMKKYFVGKNASGHVAISAKKIEGENIGAQVLGLFTLSSGKEIWQKLSLEHHHHHH

SEQ ID NO: 723 - protein, 307 aa, synthetic construct
MQITSVWTKGVTPLTPEQFRYNNYDVFHAPYLAGQGWYDITKAFDGKDNLLCGAATAGNMLHWWFDQNKTEIEAYLSKYPEKQKIIFNNQELFDLRKAINTKDSQTNSELFNYFRDKAFPNLSARQLGVMPDLVLDMFINGYYLNVFKTQSTDVNRPYQDKDKRGGIFDAVFNRGDQTKLLTARHDLKNKGLNDISTLIKQELSSGRALALSHTTANVSISHVINLWGADFNAEGNLEAIYVTDSDDDSNIGMKKYKVGINASGHVAISAKKIEGENIGAQVLGLFTLSSGKDIWQKLSLEHHHHHH

SEQ ID NO: 724 - protein, 307 aa, synthetic construct
MQITSVWTKGVTPPTPEQFTNNNEDVFHAPYLANQGWYDITKTFNGKDNLLCGAATAGNMLHWWFDQNKEQIEAYLKKHPEKQKIIFNNQEMFDLKKAIDTKDSQTNSALFNYFRDKAFPNLSARQLGVMPDLVLDMFINGYYLNVGKTQSTDVNRPYQTKDKRGGIFDAVFTRGDQTKLLTARHDLKNKGLNEISDLIKQELTEGKALALSHTYANVRINHVINLWGADFNAEGNLIAIYVTDSDSNASIGMKKYFVGVNSAGKVAISAKKIEGDNIGAQVLGLFTLSSGQDIWQKLSLEHHHHHH

SEQ ID NO: 725 - protein, 307 aa, synthetic construct
MQITSVWTKGVTPLTPEQFRNNNEDVFHAPYLPNQGWYDITKAFNGKDNLLCGAATAGNMLHWWFDQNKEEIEAYLKKYPEKQKIIFNNQELFDLRKAINTKDSQTNSALFNYFRDKAFPNLSARQLGVMPDHVLDMFINGYYLNVGKTQSTDVNRPYQDKDKRGGIFDHVFNRGDQTKLLTARHDLKNKTLNDISTLIKQELSSGKALALSHTYANVGISHVINLWGADFNAEGNLEAIYVTDSDDRASIGMKKYYVGRNASGHVAISAKKIEGENLGAQVLGLFTLSSGKEIWQKLSLEHHHHHH

SEQ ID NO: 726 - protein, 307 aa, synthetic construct
MQITTVWTKGVTPPTPEQFRNNNEDVFHAPYLPHQGWYDITKAFDGKDNLLCGAATAGNMLHWWFDQNKEEIEAYLKKYPEKQKIIFNNQELFDLRKAINTKDSQTNSQLFNYFRDKAFPNLSARQLGVMPDHVLDMFINGYYLNVFKTQSTDVNRPYQTRDKRGGIFDAVFNRGDQTTLLTERHDLYNKGLDDISTLIKQELSSGKALGLSHTYANVSISHVINLWGADFNAEGNLEAIYVTDSDDDASIGMKKYYVGKNASGHVRISAKKIEGENIGAQVLGLFTLSTGKDIWQKLSLEHHHHHH

SEQ ID NO: 727 - protein, 307 aa, synthetic construct
MQITSVWTKGVTPPTPEQFTYQNEDVFHAPYIANQGWYDITKTFNGKDNLLCGAATAGNMLHWWFDQNKTEIENYLKKHPEKQKIIFNNQEMFDLRKAINTKDSQTNSALFEYFRDKAFPNLSARQLGVMPDHVLDMFINGYYLNVTKTQSTDVNRPYQTKDKRGGIFDHVFTRGDQSKLLTARHDLKNKTLNEISDLIKQELTEGKALALSHTYANVRINHVINLWGADFDAEGNLEAIYVTDSDSNASIGMKKYFVGVNSSGKVAISAKKIEDDNIGAQVLGLFTLSSGQDIWEQLSLEHHHHHH

SEQ ID NO: 728 - protein, 307 aa, synthetic construct
MQITSVWTKGVTPPTPEQFRYYNEDVLHAPYKPHQGWYDITKTFNGKDNLLCGAATAGNMLHWWFDQNKTQIEAYLKKYPEKQKIIFNNQKMFDLRKAINTKDSQTNSALFSYFKDKAFPNLSARQRGVMPDLVLDMFINGYYLNVGKTQSTDVNRPYQTRDKRGGIFDHVFGRGDQTKLLTARHDLKNKTLNEISQLIKQELSEGKALALSHTYANVSISHVINLWGADFNAEGNLEAIYVTDSDSDAKIGMKKYYVGKNASGKVAISAKKIEGENIGAQVLGLYTLSTGKDIWQKLSLEHHHHHH

SEQ ID NO: 729 - protein, 307 aa, synthetic construct
MQITSVWTKGVTPPTMEQFRYNNYDVFHAPYLPGQGWYDITKAFDGGDNLLCGAATAGNMLHWWFDQNKEEIEAYLSKYPEKQKIIFNNQELFDLRKAINSKDSQTNSELFNYFRDKAFGNLSARQKGVMPDLVLDMFINGYYLNLNKTQSTDVNRPYQDPDKRGGIFDDVFKEGDQTKLLTARHDLSNGGLDDISTIIKQELQSGRALALSHTYANVSYSHVINLWGADFDAEGNLEAIYVTDSDDDQSIGMKKYKVGKNASGHVRISAKKIEDENIGAQVLGLFTLSLGKEIWQKLSLEHHHHHH

SEQ ID NO: 730 - protein, 307 aa, synthetic construct
MQITSVWTKGVTPPTMDDFTINGEDVFHAPYVANQGWYDITKTFNGKDDLLCGAATAGNMLHWWFDQNKEQIERYLKKHPEKQKIIFNNQEMFDLKEAINTKDSQTDSKLFNYFRDKAFPNLSARQLGVMPDHVLDMFINGYYLNLTKTQSTDVNRPEDTKDLRGGIFDHVFTRGDQSKLLTARHDLKNKTLKEISDLIKQELTEGKALGLSHTYANVRISHVINLWGADFDAEGNLEAIYVTDSDSNASIGMKKYYVGVNSAGKVAISAKKIEGDNIGAQVLGLYTLSTGKDIWQKLSLEHHHHHH

SEQ ID NO: 731 - protein, 307 aa, synthetic construct
MQITSVWTKGVTPPTMDQFTNYNYDVFHAPYKPGQGWYDITKTFDGKDNLLCGAATAGNMLHWWFDQNKEEIENYLKKHPEKQKIIFNNQKMFDLRKAINTKDSQTNSALFNYFKDKAFPNLSARQKGVMPDLVLDMFINGYYLNLGKTQSTDVNREYQTKDSRGGIFDDVFGRGDQTKLLTARHDLYNGGLNDISQLIKQELSSGKALGLSHTYANVRYSHVINLWGADFDEEGNLEAIYVTDSDDDASIGMKKYYVGKNASGKVAISAKKIEGENIGAQVLGLFTLSSGKEIWQKLSLEHHHHHH

SEQ ID NO: 732 - protein, 307 aa, synthetic construct
MQITSVWTKGVIPPTMDQFRYNNYDVFHAPYLPHQGWYDITKTFDGGDNLLCGAATAGNMLHWWFDQNKEYIENYLKKYPEKQKIIFNNQELFDLRKAINTKDSQTNSELFNYFRDKAFGNLSARQKGVMPDLVLDMFINGYYLNLFKTQSTDVNRPNDTRDKRGGFFDHVFGRGDQTKLLTARHDLYNGGLSDISQLIKQELQSGKALAISHTYGNVSSSHVINLWGADFDAEGNLEAIYVTDSDDRSSIGMKKYYVGINASGKVAISAKKIEGENVGAQVLGLFTLSSGKEIWKKLSLEHHHHHH

SEQ ID NO: 733 - protein, 307 aa, synthetic construct
MQITTVWTKGVTPLTPEQFRYNNEEVIHAPYKAGQGWYDITKVFDGKDNLLCGAATAGNMLHWWFDQNKTEIEAYLSKHPEKQKIIFNNQELFDLKRAIDDKDSQTNSQLFNYFRDKAFPNLSARQLGVMPDLVLDMFINGYYLNVFKTQSTDVNRPYQDPDKRGGIFDDVFGKGDQTTLLTARHDLKNLGLEDISTIIKQELRNGRALALSHTYANVSISHVINLWGADFNAEGNLSAIYVTDSDANNSIGMKKYKVGYNAHGRVAISAKKIEGENIGAQVLGLFTLSSGKDIWQKLSLEHHHHHH

SEQ ID NO: 734 - protein, 307 aa, synthetic construct
MQITSVWTKGVTPLTPEQFRYNNEDVIHAPYLAHQGWYDITKTFDGKDNLLCGAATAGNMLHWWFDQNKTEIEAYLSKHPEKQKIIFNNQELFDLKEAINTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTIIKQELTEGKALALSHTYANVSISHVINLWGADFNAEGNLEAIYVTDSDANASIGMKKYFVGINAHGHVAISAKKIEGENIGAQVLGLFTLSSGKDIWQKLSLEHHHHHH

SEQ ID NO: 735 - protein, 307 aa, synthetic construct
MQITSVWTKGVTPLTPEQFRYNNEDVIHAPYLPHQGWYDITKAFDGKDNLLCGAATAGNMLHWWFDQNKTEIEAYLSKHPEKQKIIFNNQELFDLRAAINTKDSQTNSALFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGKALALSHTYANVSISHVINLWGADFNAEGNLEAIYVTDSDANASIGMKKYYVGINAHGHVAISAKKIEGENIGAQVLGLFTLSSGKDIWQKLSLEHHHHHH

SEQ ID NO: 736 - protein, 307 aa, synthetic construct
MQITSVWTKGVTPLTPEQFRYNNEDVIHAPYLAHQGWYDITKAFDGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYYVGINAHGHVAISAKKIEGENIGAQVLGLFTLSSGKEIWQKLSLEHHHHHH

SEQ ID NO: 737 - protein, 307 aa, synthetic construct
MQITSVWTKGVTPLTPEQFRNNNEDVIHAPYLANQGWYDITKTFNGKDNLLCGAATAGNMLHWWFDQNKTEIEAYLKKHPEKQKIIFNNQELFDLKKAIDTKDSQTNSQLFNYFRDKAFPNLSARQLGVMPDLVLDMFINGYYLNVFKTQSTDVNRPYQDKDKRGGIFDAVFTRGDQTTLLTSRHDLKNKGLNEISDIIKQELTEGKALALSHTYANVSISHVINLWGADFNAEGNLEAIYVTDSDANASIGMKKYFVGVNAHGKVAISAKKIEGENIGAQVLGLFTLSSGKDIWQKLSLEHHHHHH

SEQ ID NO: 738 - protein, 307 aa, synthetic construct
MQITSVWTKGVTPLTPEQFRYNNEDVIHAPYLAHQGWYDITKAFNGKDNLLCGAATAGNMLHWWFDQNKEEIEAYLKKHPEKQKIIFNNQELFDLRKAINTKDSQTNSQLFNYFRDKAFPNLSARQLGVMPDLVLDMFINGYYLNVFKTQSTDVNRPYQDKDKRGGIFDHVFTRGDQTTLLTARHDLKNKTLNDISQIIKQELQEGKALALSHTYANVSISHVINLWGADFNAEGNLEAIYVTDSDANASIGMKKYFVGKNAHGHVAISAKKIEGENIGAQVLGLFTLSSGKEIWQKLSLEHHHHHH

SEQ ID NO: 739 - protein, 307 aa, synthetic construct
MQITSVWTKGVTPLTPEQFTNNNEDVIHAPYLANQGWYDITKTFNGKDNLLCGAATAGNMLHWWFDQNKEEIEAYLKKHPEKQKIIFNNQELFDLKKAIDTKDSQTNSALFNYFRDKAFPNLSARQLGVMPDLVLDMFINGYYLNVFKTQSTDVNRPYQTKDKRGGIFDAVFTRGDQTTLLTARHDLKNKGLNEISDIIKQELTEGKALALSHTYANVSISHVINLWGADFNAEGNLIAIYVTDSDANASIGMKKYFVGVNSHGKVAISAKKIEGENIGAQVLGLFTLSSGQDIWQKLSLEHHHHHH

SEQ ID NO: 740 - protein, 307 aa, synthetic construct
MQITSVWTKGVTPLTPEQFRNNNEDVIHAPYLPNQGWYDITKAFNGKDNLLCGAATAGNMLHWWFDQNKEEIEAYLKKYPEKQKIIFNNQELFDLRKAINTKDSQTNSALFNYFRDKAFPNLSARQLGVMPDLVLDMFINGYYLNVFKTQSTDVNRPYQDKDKRGGIFDHVFNRGDQTTLLTARHDLKNKTLNDISTIIKQELSSGKALALSHTYANVSISHVINLWGADFNAEGNLEAIYVTDSDANASIGMKKYYVGRNAHGHVAISAKKIEGENIGAQVLGLFTLSSGKEIWQKLSLEHHHHHH

SEQ ID NO: 741 - protein, 307 aa, synthetic construct
MQITSVWTKGVTPLTPEQFTYNNEDVIHAPYIANQGWYDITKTFNGKDNLLCGAATAGNMLHWWFDQNKTEIENYLKKHPEKQKIIFNNQELFDLRKAINTKDSQTNSALFNYFRDKAFPNLSARQLGVMPDLVLDMFINGYYLNVFKTQSTDVNRPYQTKDKRGGIFDHVFTRGDQSTLLTARHDLKNKTLNEISDIIKQELTEGKALALSHTYANVSISHVINLWGADFNAEGNLEAIYVTDSDANASIGMKKYFVGVNSHGKVAISAKKIEDENIGAQVLGLFTLSSGQDIWEQLSLEHHHHHH

SEQ ID NO: 742 - protein, 307 aa, synthetic construct
MQITSVWTKGVTPLTPEQFRYNNEDVIHAPYKPHQGWYDITKTFNGKDNLLCGAATAGNMLHWWFDQNKTEIEAYLKKYPEKQKIIFNNQKLFDLRKAINTKDSQTNSALFNYFRDKAFPNLSARQLGVMPDLVLDMFINGYYLNVFKTQSTDVNRPYQTRDKRGGIFDHVFGRGDQTTLLTARHDLKNKTLNEISQIIKQELSEGKALALSHTYANVSISHVINLWGADFNAEGNLEAIYVTDSDANAKIGMKKYYVGKNAHGKVAISAKKIEGENIGAQVLGLFTLSSGKDIWQKLSLEHHHHHH

SEQ ID NO: 743 - protein, 307 aa, synthetic construct
MQITSVWTKGVTPLTMDDFTINNEDVIHAPYVANQGWYDITKTFNGKDNLLCGAATAGNMLHWWFDQNKEEIERYLKKHPEKQKIIFNNQELFDLKEAINTKDSQTDSKLFNYFRDKAFPNLSARQLGVMPDLVLDMFINGYYLNVFKTQSTDVNRPYDTKDKRGGIFDHVFTRGDQSTLLTARHDLKNKTLKEISDIIKQELTEGKALALSHTYANVSISHVINLWGADFNAEGNLEAIYVTDSDANASIGMKKYYVGVNSHGKVAISAKKIEGENIGAQVLGLFTLSSGKDIWQKLSLEHHHHHH

SEQ ID NO: 744 - protein, 307 aa, synthetic construct
MQITSVWTKGVTPLTMDQFTNNNEDVIHAPYKPGQGWYDITKTFDGKDNLLCGAATAGNMLHWWFDQNKEEIENYLKKHPEKQKIIFNNQKLFDLRKAINTKDSQTNSALFNYFRDKAFPNLSARQLGVMPDLVLDMFINGYYLNVFKTQSTDVNREYQTKDKRGGIFDDVFGRGDQTTLLTARHDLKNGGLNDISQIIKQELSSGKALALSHTYANVSISHVINLWGADFNEEGNLEAIYVTDSDANASIGMKKYYVGKNAHGKVAISAKKIEGENIGAQVLGLFTLSSGKEIWQKLSLEHHHHHH

SEQ ID NO: 745 - protein, 307 aa, synthetic construct
MQITSVWTKGVTPPTPEQFRYNNEDVIHAPYLANQGWYDITKTFNGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDKDKRGGIFDAVFNRGDQTTLLTARHDLKNKTLNDISTLIKQELSSGKALALSHTYANVSISHVINLWGADFNAEGNLEAIYVTDSDANSNIGMKKYKVGVNAHGKVAISAKKIEGENIGAQVLGLFTLSSGKDIWQKLSLEHHHHHH

SEQ ID NO: 746 - protein, 307 aa, synthetic construct
MQITTVWTKGVTPPTPEQFRYNNEDVIHAPYLPNQGWYDITKTFNGKDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDRDKRGGIFDAVFNRGDQTTLLTARHDLKNKTLNDISTLIKQELSSGKALALSHTYANVSISHVINLWGADFNAEGNLEAIYVTDSDANASIGMKKYYVGVNAHGKVAISAKKIEGENIGAQVLGLFTLSSGKDIWQKLSLEHHHHHH

SEQ ID NO: 747 - protein, 307 aa, synthetic construct
MQITSVWTKGVTPPTPEQFRYNNEDVIHAPYLPNQGWYDITKTFNGGDNLLCGAATAGNMLHWWFDQNKTEIEAYLSKYPEKQKIIFNNQELFDLRAAINSKDSQTNSQLFNYFRDKAFPNLSARQLGVMPDLVLDMFINGYYLNVFKTQSTDVNRPYQDPDKRGGIFDDVFKEGDQTTLLTARHDLKNGTLNDISTLIKQELQSGKALALSHTYANVSISHVINLWGADFNAEGNLEAIYVTDSDANQSIGMKKYKVGVNAHGKVAISAKKIEGENIGAQVLGLFTLSSGKEIWQKLSLEHHHHHH

SEQ ID NO: 748 - protein, 307 aa, synthetic construct
MQITSVWTKGVIPPTPEQFRYNNEDVIHAPYLPNQGWYDITKTFNGGDNLLCGAATAGNMLHWWFDQNKTEIEAYLSKYPEKQKIIFNNQELFDLRAAINTKDSQTNSQLFNYFRDKAFPNLSARQLGVMPDLVLDMFINGYYLNVFKTQSTDVNRPYQDRDKRGGIFDHVFGRGDQTTLLTARHDLKNGTLNDISTLIKQELQSGKALALSHTYANVSISHVINLWGADFNAEGNLEAIYVTDSDANSSIGMKKYYVGVNAHGKVAISAKKIEGENIGAQVLGLFTLSSGKEIWQKLSLEHHHHHH

SEQ ID NO: 749 - protein, 307 aa, synthetic construct
MTITSVWTKGVTPPTPEDFRYNNEDVLHAPYVANQGWYDITKTFDGKDNLLCGAATAGNMLHWWFDQNKEEIERYLKKYPEKQKIIFNNQELFDVRAAINTKDSQTNSKLFNYFRDKAFPNLSARQLGVMPDLVLDMFINGYYLNLGKTQSTDVNRPYQDKDKRGGIFDAVFNRGDQTTLLTARHDLKNKGLNEISDLIKQELSSGKALALSHTYANVRINHVINLWGADFDAEGNLIAIYVTDSDANSNIGMKKYKVGVNANGKVAISAKKIEGDNIGAQVLGLFTLSTGQDIWQKLSLEHHHHHH

SEQ ID NO: 750 - protein, 307 aa, synthetic construct
MTITTVWTKGVTPPTPEDFRYNNEDVLHAPYVPNQGWYDITKTFDGKDNLLCGAATAGNMLHWWFDQNKEEIERYLKKYPEKQKIIFNNQELFDVRAAINTKDSQTNSKLFNYFRDKAFPNLSARQLGVMPDLVLDMFINGYYLNLGKTQSTDVNRPYQDRDKRGGIFDAVFNRGDQTTLLTARHDLKNKGLNEISDLIKQELSSGKALALSHTYANVRINHVINLWGADFDAEGNLIAIYVTDSDANASIGMKKYYVGVNANGKVAISAKKIEGDNIGAQVLGLFTLSTGQDIWQKLSLEHHHHHH

SEQ ID NO: 751 - protein, 307 aa, synthetic construct
MTITSVWTKGVTPPTPEDFRYNNEDVLHAPYVPNQGWYDITKTFDGGDNLLCGAATAGNMLHWWFDQNKEEIERYLKKYPEKQKIIFNNQELFDVRAAINSKDSQTNSKLFNYFRDKAFPNLSARQLGVMPDLVLDMFINGYYLNLGKTQSTDVNRPYQDPDKRGGIFDDVFKEGDQTTLLTARHDLKNGGLNEISDLIKQELQSGKALALSHTYANVRINHVINLWGADFDAEGNLIAIYVTDSDANQSIGMKKYKVGVNANGKVAISAKKIEGDNIGAQVLGLFTLSTGQEIWQKLSLEHHHHHH

SEQ ID NO: 752 - protein, 307 aa, synthetic construct
MTITSVWTKGVIPPTPEDFRYNNEDVLHAPYVPNQGWYDITKTFDGGDNLLCGAATAGNMLHWWFDQNKEEIERYLKKYPEKQKIIFNNQELFDVRAAINTKDSQTNSKLFNYFRDKAFPNLSARQLGVMPDLVLDMFINGYYLNLGKTQSTDVNRPYQDRDKRGGIFDHVFGRGDQTTLLTARHDLKNGGLNEISDLIKQELQSGKALALSHTYANVRINHVINLWGADFDAEGNLIAIYVTDSDANSSIGMKKYYVGVNANGKVAISAKKIEGDNIGAQVLGLFTLSTGQEIWQKLSLEHHHHHH

SEQ ID NO: 753 - protein, 292 aa, synthetic construct
VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 754 - protein, 294 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 755 - protein, 298 aa, synthetic construct
QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 756 - protein, 333 aa, synthetic construct
SQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 757 - protein, 292 aa, synthetic construct
VTSVWTKGVTPPANFTQGEDVFHAPYKANQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTN

SEQ ID NO: 758 - protein, 292 aa, synthetic construct
VTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTN

SEQ ID NO: 759 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 760 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 761 - protein, 294 aa, synthetic construct
ITSVWTKGVTPPAKFTQGEDVFHAPYVANQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTN

SEQ ID NO: 762 - protein, 298 aa, synthetic construct
TITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 763 - protein, 298 aa, synthetic construct
QITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLNDISTLIKQELTEGKALALSHTYANVSISHVINLWGADFNAEGNLEAIYVTDSDANASIGMKKYFVGVNAHGKVAISAKKIEGENIGAQVLGLFTLSSGKDIWQKLS

SEQ ID NO: 764 - protein, 298 aa, synthetic construct
QITSVWTKGVTPLTPEQFRYNNEDVIHAPYLANQGWYDITKTFNGKDNLLCGAATAGNMLHWWFDQNKTEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTLIKQELTEGKALALSHTYANVSISHVINLWGADFNAEGNLEAIYVTDSDSNASIGMKKYFVGVNAHGKVAISAKKIEGENIGAQVLGLFTLSSGKDIWQKLS

SEQ ID NO: 765 - protein, 298 aa, synthetic construct
QITSVWTKGVTPPTPEQFRYNNEDVFHAPYTAHQGWYDITKTFDGKDNLLCGAATAGNMLHWWFDQNKTEIEAYLSKHPEKQKIIFNNQELFDLKAAIDTKDSQTNSALFNYFRDKAFPNLSARQLGVMPDLVLDMFINGYYLNVFKTQSTDVNRPYQDKDKRGGIFDAVFTRGDQTTLLTARHDLKNKTLNDISTIIKQELTEGRALALSHTYANVSISHVINLWGADFNAEGNLEAIYVTDSDSNASIGMKKYFVGVNASGKVAISAKKIEGENIGAQVLGLFTLSSGKDIWQKLS

SEQ ID NO: 766 - protein, 333 aa, synthetic construct
SQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 767 - protein, 333 aa, synthetic construct
SQTEDSESLQRLRDIEDFQAEKKKQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 768 - protein, 292 aa, synthetic construct
VTSVWTKGVTPPANFTQGEDVFHAPYVANQGWYDITKTFNGKDNLLCGAATAGNMLHWWFDQNKDQIKRYLEEHPEKQKINFNGEQLFDVKEAIDTKNHQLDSKLFEYFKEKAFPYLSTKHLGVFPDHVIDMFINGYRLSLTNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTNASIGMKKYFVGVNSAGKVAISAKEIKEDNIGAQVLGLFTLSTGQDSWNQTN

SEQ ID NO: 769 - protein, 294 aa, synthetic construct
VTSVWTKGVTPPAKFTQGEDVFHAPYVANQGWYDITKTFNGKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVRINHVINLWGADFDSNGNLKAIYVTDSDTNASIGMKKYFVGVNSAGKVAISAKEIKEDNIGAQVLGLFTLSTGQDSWNQTN

SEQ ID NO: 770 - protein, 298 aa, synthetic construct
QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYFVGINAHGHVAISAKKIEGENIGAQVLGLFTLSSGKDIWQKLS

SEQ ID NO: 771 - protein, 333 aa, synthetic construct
SQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 772 - protein, 292 aa, synthetic construct
VTSVWTKGVTPPANFTQGEDVFHAPYVANQGWYDITKTFNRKDNLLCGAATAGNMLHWWFDQNKDQIKRYLEEHPEKQKINFKGEQLFDVKEAIDTKNHQLDSKLFEYFKEKAFPYLSTKHLGVFPDHVIDMFINGYRLSLTNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYFVGVNKAGKVAISAKEIKEDNIGAQVLGLFTLSTGQDSWNQTN

SEQ ID NO: 773 - protein, 294 aa, synthetic construct
VTSVWTKGVTPPAKFTQGEDVFHAPYVANQGWYDITKTFNRKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVRINHVINLWGADFDSNGNLKAIYVTDSDTRASIGMKKYFVGVNAAGKVAISAKEIKEDNIGAQVLGLFTLSTGQDSWNQTN

SEQ ID NO: 774 - protein, 298 aa, synthetic construct
QITSVWTKGVTPLTPEQFRYYNEDVIHAPYLAHQGWYDITKAFDGKDNLLCGAATAGNMLHWWFDQNKTEIEAYLSKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYFVGINAHGHVAISAKKIEGENIGAQVLGLFTLSSGKDIWQKLS

SEQ ID NO: 775 - protein, 333 aa, synthetic construct
SQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 776 - protein, 292 aa, synthetic construct
VTSVWTKGVTPPANFTQGEDVFHAPYKANQGWYDITKTFNGKDNLLCGAATAGNMLHWWFDQNKDQIEAYLKEHPEKQKINFNGEQLFDVKEAIDTKDDQTNSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTN

SEQ ID NO: 777 - protein, 292 aa, synthetic construct
VTSVWTKGVTPPANFTQGEDVFHAPYVANQGWYDITKTFNGKDNLLCGAATAGNMLHWWFDQNKDQIERYLKEHPEKQKINFNGEQLFDVKEAIDTKDSQTDSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTN

SEQ ID NO: 778 - protein, 292 aa, synthetic construct
VTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 779 - protein, 294 aa, synthetic construct
VTSVWTKGVTPPADFTQGEDVFHAPYVANQGWYDITKTFNGKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTN

SEQ ID NO: 780 - protein, 294 aa, synthetic construct
ITSVWTKGVTPPAKFTQGEDVFHAPYVANQGWYDITKTFNGKDNLLCGAATAGNMLHWWFDQNKEEIEAYLKKHPEKQKIIFGDQELLDVRKVINTKDSQTNSALFNYFKDKAFPNLSARRLGVFPDLVLDMFINGYYLNVYKTQTTDVNRTYQTKDRRGGIFDAVFTRGVQSKLLTERHDFKEKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTN

SEQ ID NO: 781 - protein, 298 aa, synthetic construct
TITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLS

SEQ ID NO: 782 - protein, 298 aa, synthetic construct
QITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKTLNDISTLIKQELTEGKALALSHTYANVRISHVINLWGADFNAEGNLEAIYVTDSDANASIGMKKYFVGVNAHGKVAISAKKIEGENIGAQVLGLFTLSSGKDIWQKLS

SEQ ID NO: 783 - protein, 298 aa, synthetic construct
QITSVWTKGVTPLTPEQFRYNNEDVIHAPYLANQGWYDITKTFNGKDNLLCGAATAGNMLHWWFDQNKTEIEAYLKKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNEISTLIKQELTEGKALALSHTYANVRISHVINLWGADFNAEGNLEAIYVTDSDSNASIGMKKYFVGVNAHGKVAISAKKIEGENIGAQVLGLFTLSSGKDIWQKLS

SEQ ID NO: 784 - protein, 298 aa, synthetic construct
QITSVWTKGVTPPTPEQFRYNNEDVFHAPYTAHQGWYDITKTFDGKDNLLCGAATAGNMLHWWFDQNKTEIEAYLSKHPEKQKIIFNNQELFDLKAAIDTKDSQTNSALFNYFRDKAFPGLSARQLGVFPDLVLDMFINGYYLNVFKTQSTDVNRPYQDKDKRGGIFDAVFTRGVQTTLLTARHDLKNKTLNDISTIIKQELTEGRALALSHTYANVRISHVINLWGADFNAEGNLEAIYVTDSDSNASIGMKKYFVGVNASGKVAISAKKIEGENIGAQVLGLFTLSSGKDIWQKLS

SEQ ID NO: 785 - protein, 333 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 786 - protein, 333 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 787 - protein, 292 aa, synthetic construct
VTSVWTKGVTPPANFTQGEDVFHAPYKANQGWYDITKTFNRKDNLLCGAATAGNMLHWWFDQNKDQIEAYLKEHPEKQKINFKGEQLFDVKEAIDTKDDQTNSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALALSHTYANVRINHVINLWGADFDSNGNLEAIYVTDSDTEASIGMKKYFVGVNKAGKVAISAKEIEDDNIGAQVLGLFTLSTGQDIWNQTN

SEQ ID NO: 788 - protein, 292 aa, synthetic construct
VTSVWTKGVTPPANFTQGEDVFHAPYVANQGWYDITKTFNRKDNLLCGAATAGNMLHWWFDQNKDQIERYLKEHPEKQKINFKGEQLFDVKEAIDTKDSQTDSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALGLSHTYANVRINHVINLWGADFDSEGNLKAIYVTDSDTEASIGMKKYFVGVNKAGKVAISAKEIKEDNIGAQVLGLFTLSTGQDIWNQTN

SEQ ID NO: 789 - protein, 292 aa, synthetic construct
VTSVWTKGVTPPTNFTYGEDVLHAPYVANQGWYDITKTFNRKDNLLCGAATAGNMLHWWFDQNKEQIENYLKKHPEKQKINFKGEQLFDVKEAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYFVGVNKNGKVAISAKEIEEDNIGAQVLGLFTLSTGQDIWNQTN

SEQ ID NO: 790 - protein, 294 aa, synthetic construct
VTSVWTKGVTPPADFTQGEDVFHAPYVANQGWYDITKTFNRKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDTRASIGMKKYFVGVNAAGKVAISAKEIKEDNIGAQVLGLFTLSTGQDIWNQTN

SEQ ID NO: 791 - protein, 294 aa, synthetic construct
ITSVWTKGVTPPAKFTQGEDVFHAPYVANQGWYDITKTFNRKDNLLCGAATAGNMLHWWFDQNKEEIEAYLKKHPEKQKIIFGDQELLDVRKVINTKDSQTNSALFNYFKDKAFPNLSARRLGVFPDLVLDMFINGYYLNVYKTQTTDVNRTYQTKDRRGGIFDAVFTRGVQSKLLTERHDFKEKTLKEISDLIKQELTEGKALGLSHTYANVRINHVINLWGADFDSNGNLEAIYVTDSDTRASIGMKKYFVGVNAAGKVAISAKEIKEDNIGAQVLGLFTLSTGQDIWNQTN

SEQ ID NO: 792 - protein, 298 aa, synthetic construct
TITSVWTKGVTPPTPEDFRYYNEDVLHAPYVANQGWYDITKTFDGKDNLLCGAATAGNMLHWWFDQNKEEIERYLKKHPEKQKIIFKNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYFVGVNANGKVAISAKKIEGDNIGAQVLGLFTLSTGQDIWQKLS

SEQ ID NO: 793 - protein, 298 aa, synthetic construct
QITSVWTKGVTPPTPEQFRYYNEDVIHAPYLANQGWYDITKTFNGKDNLLCGAATAGNMLHWWFDQNKTEIEAYLSKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKTLNDISTLIKQELTEGKALALSHTYANVRISHVINLWGADFNAEGNLEAIYVTDSDTRASIGMKKYFVGVNAHGKVAISAKKIEGENIGAQVLGLFTLSSGKDIWQKLS

SEQ ID NO: 794 - protein, 298 aa, synthetic construct
QITSVWTKGVTPLTPEQFRYYNEDVIHAPYLANQGWYDITKTFNGKDNLLCGAATAGNMLHWWFDQNKTEIEAYLKKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNEISTLIKQELTEGKALALSHTYANVRISHVINLWGADFNAEGNLEAIYVTDSDSRASIGMKKYFVGVNAHGKVAISAKKIEGENIGAQVLGLFTLSSGKDIWQKLS

SEQ ID NO: 795 - protein, 298 aa, synthetic construct
QITSVWTKGVTPPTPEQFRYYNEDVFHAPYTAHQGWYDITKTFDGKDNLLCGAATAGNMLHWWFDQNKTEIEAYLSKHPEKQKIIFKNQELFDLKAAIDTKDSQTNSALFNYFRDKAFPGLSARQLGVFPDLVLDMFINGYYLNVFKTQSTDVNRPYQDKDKRGGIFDAVFTRGVQTTLLTARHDLKNKTLNDISTIIKQELTEGRALALSHTYANVRISHVINLWGADFNAEGNLEAIYVTDSDSRASIGMKKYFVGVNASGKVAISAKKIEGENIGAQVLGLFTLSSGKDIWQKLS

SEQ ID NO: 796 - protein, 333 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDRNRDNVDRFLRQNPEKHGIIELPDEQLKLSDFLNTYESDDGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 797 - protein, 333 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 798 - protein, 292 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 799 - protein, 292 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 800 - protein, 296 aa, synthetic construct
VTSVWTKGVTPPTDFRKIVDGNIAYYHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 801 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTN

SEQ ID NO: 802 - protein, 292 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 803 - protein, 292 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 804 - protein, 292 aa, synthetic construct
VTSVWTKGVTPPTDFIYGEDVLHAPYKAGQGWYDITKAFDGGDNLLCGAATAGNMLHWWFDQNKEQIENYLKKHPEKQKIIFNNQELFDLKAAIDTKDSQTNSELFNYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 805 - protein, 292 aa, synthetic construct
VTSVWTKGVTPPTNFTYGEDVLHAPYVANQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTN

SEQ ID NO: 806 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 807 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 808 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 809 - protein, 294 aa, synthetic construct
VTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 810 - protein, 294 aa, synthetic construct
VTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 811 - protein, 294 aa, synthetic construct
VTSVWTKGVTPPADFTQGEDVFHAPYVANQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTN

SEQ ID NO: 812 - protein, 292 aa, synthetic construct
VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSSGKVAISAKEIKEDNIGAQVLGLFTLSTGQDSWNQTN

SEQ ID NO: 813 - protein, 292 aa, synthetic construct
VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 814 - protein, 292 aa, synthetic construct
VTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIYVTDSDSNPSIGMKKYFVGVNSSGKVAISAKEIKEDNIGAQVLGLFTLSTGQDSWNQTN

SEQ ID NO: 815 - protein, 292 aa, synthetic construct
VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 816 - protein, 292 aa, synthetic construct
VTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIAVTDSDSNASIGMKKYFVGVNSSGKVAISAKEIKEDNIGAQVLGLFTLSTGQDSWNQTN

SEQ ID NO: 817 - protein, 292 aa, synthetic construct
VTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 818 - protein, 292 aa, synthetic construct
VTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 819 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 820 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 821 - protein, 292 aa, synthetic construct
VTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 822 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 823 - protein, 292 aa, synthetic construct
VTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 824 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYFVGVNSDGKVAISAKEIEEDNIGAQVLGLFTLSTGQDIWNQTN

SEQ ID NO: 825 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYPVGVNSNGKVAISAKEIEEDNIGAQVLGLFTLSTGQDIWNQTN

SEQ ID NO: 826 - protein, 292 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 827 - protein, 292 aa, synthetic construct
VTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 828 - protein, 292 aa, synthetic construct
VTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 829 - protein, 292 aa, synthetic construct
VTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 830 - protein, 292 aa, synthetic construct
VTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 831 - protein, 292 aa, synthetic construct
VTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 832 - protein, 292 aa, synthetic construct
VTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 833 - protein, 292 aa, synthetic construct
VTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 834 - protein, 292 aa, synthetic construct
VTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 835 - protein, 292 aa, synthetic construct
VTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 836 - protein, 292 aa, synthetic construct
VTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 837 - protein, 292 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 838 - protein, 292 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 839 - protein, 292 aa, synthetic construct
VTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 840 - protein, 292 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 841 - protein, 292 aa, synthetic construct
VTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 842 - protein, 292 aa, synthetic construct
VTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 843 - protein, 292 aa, synthetic construct
VTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 844 - protein, 292 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 845 - protein, 292 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 846 - protein, 292 aa, synthetic construct
VTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 847 - protein, 292 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 848 - protein, 292 aa, synthetic construct
VTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 849 - protein, 292 aa, synthetic construct
VTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 850 - protein, 292 aa, synthetic construct
VTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 851 - protein, 294 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVGINHVINLWGADFDSNGNLKAIYVTDSDSNASIGMKKYFVGVNSSGKVAISAKEIKEDNIGAQVLGLFTLSTGQDSWNQTN

SEQ ID NO: 852 - protein, 294 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYFVGVNSSGKVAISAKEIKEDNIGAQVLGLFTLSTGQDSWNQTN

SEQ ID NO: 853 - protein, 294 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYFVGVNSSGKVAISAKEIKEDNIGAQVLGLFTLSTGQDSWNQTN

SEQ ID NO: 854 - protein, 294 aa, synthetic construct
VTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSAGKVAISAKEIKEDNIGAQVLGLFTLSTGQDSWNQTN

SEQ ID NO: 855 - protein, 294 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYGVGVNSAGKVAISAKEIKEDNIGAQVLGLFTLSTGQDSWNQTN

SEQ ID NO: 856 - protein, 294 aa, synthetic construct
VTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYGVGVNSAGKVAISAKEIKEDNIGAQVLGLFTLSTGQDSWNQTN

SEQ ID NO: 857 - protein, 294 aa, synthetic construct
VTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSSGKVAISAKEIKEDNIGAQVLGLFTLSTGQDSWNQTN

SEQ ID NO: 858 - protein, 294 aa, synthetic construct
VTSVWTKGVTPPAKFTQGEDVFHAPYVANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 859 - protein, 294 aa, synthetic construct
VTSVWTKGVTPPAKFTQGEDVFHAPYDANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 860 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 861 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 862 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 863 - protein, 294 aa, synthetic construct
VTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 864 - protein, 294 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 865 - protein, 294 aa, synthetic construct
VTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 866 - protein, 294 aa, synthetic construct
VTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 867 - protein, 294 aa, synthetic construct
VTSVWTKGVTPPADFTQGEDVFHAPYVANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 868 - protein, 294 aa, synthetic construct
VTSVWTKGVTPPADFTQGEDVFHAPYDANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 869 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 870 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 871 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 872 - protein, 294 aa, synthetic construct
VTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 873 - protein, 294 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 874 - protein, 294 aa, synthetic construct
VTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 875 - protein, 294 aa, synthetic construct
VTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 876 - protein, 294 aa, synthetic construct
VTSVWTKGVTPPTDFIKGEDVFHAPYKAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 877 - protein, 294 aa, synthetic construct
VTSVWTKGVTPPTDFIKGEDVFHAPYDAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 878 - protein, 298 aa, synthetic construct
QITSVWTKGVTPLTPEQFRKNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGRNAHGHVAISAKKIEGENIGAQVLGLFTLSSGKDIWQKLS

SEQ ID NO: 879 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSLGKDIWQKLS

SEQ ID NO: 880 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 881 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 882 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFNNQEWFDLKAAIDTKDSQTNSQLFNYFRDKAFPNLSARQLGVMPDLVLDMFINGYYLNVPKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYAVGINAHGHVAISAKKIEGENIGAQVLGLFTLSSGKDIWQKLS

SEQ ID NO: 883 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANPSIGMKKYFVGRNAHGHVAISAKKIEGENIGAQVLGLFTLSSGKDIWQKLS

SEQ ID NO: 884 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 885 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDQWQKLS

SEQ ID NO: 886 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 887 - protein, 298 aa, synthetic construct
TITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 888 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 889 - protein, 298 aa, synthetic construct
TITSVWTKGVTPPTPEDFRYNNEDVLHAPYVANQGWYDITKTFDGKDNLLCGAATAGNMLHWWFDQNKEEIERYLKKHPEKQKIIFNNQEWFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSLGQDIWQKLS

SEQ ID NO: 890 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 891 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 892 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDQWQKLS

SEQ ID NO: 893 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 894 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 895 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 896 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 897 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 898 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 899 - protein, 298 aa, synthetic construct
TITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 900 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 901 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 902 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 903 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 904 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 905 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 906 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 907 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 908 - protein, 298 aa, synthetic construct
TITSVWTKGVTPPTPEDFRKNNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDIWQKLS

SEQ ID NO: 909 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSLGQDIWQKLS

SEQ ID NO: 910 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 911 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 912 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYAVGVNAHGKVAISAKKIEGDNIGAQVLGLFTLSTGQDIWQKLS

SEQ ID NO: 913 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANPSIGMKKYFVGRNAHGKVAISAKKIEGDNIGAQVLGLFTLSTGQDIWQKLS

SEQ ID NO: 914 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 915 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDQWQKLS

SEQ ID NO: 916 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 917 - protein, 333 aa, synthetic construct
SQTEDSESLQRLRDIEDFQAEKEMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 918 - protein, 333 aa, synthetic construct
SQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 919 - protein, 333 aa, synthetic construct
SQTEDSESLQRLRDIEDFQAEKKDQNVVYTKWLDGVDVKDHDFRKIVDGNIAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 920 - protein, 333 aa, synthetic construct
SQTEDSESLQRLRDIEDFQAEKKDQNVVYTKWLDGVDVKDHDFRKIVDGNIAYYATPLLNGRGLYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 921 - protein, 333 aa, synthetic construct
SQTEDSESLQRLRDIEDFQAEKKDQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 922 - protein, 333 aa, synthetic construct
SQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 923 - protein, 333 aa, synthetic construct
SQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 924 - protein, 333 aa, synthetic construct
SQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 925 - protein, 333 aa, synthetic construct
SQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 926 - protein, 333 aa, synthetic construct
SQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 927 - protein, 333 aa, synthetic construct
SQTEDSESLQRLRDIEDFQAEKEKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 928 - protein, 333 aa, synthetic construct
SQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 929 - protein, 333 aa, synthetic construct
SQTEDSESLQRLRDIEDFQAEKKDQNVVYTKWLDGVDVKDHDFRKIVDGNIAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 930 - protein, 333 aa, synthetic construct
SQTEDSESLQRLRDIEDFQAEKKDQNVVYTKWLDGVDVKDHDFRKIVDGNIAYYATPLLNGRGLYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 931 - protein, 333 aa, synthetic construct
SQTEDSESLQRLRDIEDFQAEKKDQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 932 - protein, 333 aa, synthetic construct
SQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 933 - protein, 333 aa, synthetic construct
SQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 934 - protein, 333 aa, synthetic construct
SQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 935 - protein, 333 aa, synthetic construct
SQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 936 - protein, 333 aa, synthetic construct
SQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 937 - protein, 333 aa, synthetic construct
SQTEDSESLQRLRDIEDFQAEKEKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 938 - protein, 333 aa, synthetic construct
SQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 939 - protein, 333 aa, synthetic construct
SQTEDSESLQRLRDIEDFQAEKKDQNVVYTKWLDGVDVKDHDFRKIVDGNIAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 940 - protein, 333 aa, synthetic construct
SQTEDSESLQRLRDIEDFQAEKKDQNVVYTKWLDGVDVKDHDFRKIVDGNIAYYATPLLNGRGLYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 941 - protein, 333 aa, synthetic construct
SQTEDSESLQRLRDIEDFQAEKKDQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 942 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 943 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 944 - protein, 333 aa, synthetic construct
SQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 945 - protein, 333 aa, synthetic construct
SQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 946 - protein, 333 aa, synthetic construct
SQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDSTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 947 - protein, 294 aa, synthetic construct; identical to SEQ ID NO: 769

SEQ ID NO: 948 - protein, 298 aa, synthetic construct; identical to SEQ ID NO: 770

SEQ ID NO: 949 - protein, 333 aa, synthetic construct; identical to SEQ ID NO: 771

SEQ ID NO: 950 - protein, 292 aa, synthetic construct
VTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 951 - protein, 292 aa, synthetic construct; identical to SEQ ID NO: 950

SEQ ID NO: 952 - protein, 292 aa, synthetic construct; identical to SEQ ID NO: 950

SEQ ID NO: 953 - protein, 306 aa, synthetic construct; identical to SEQ ID NO: 26

SEQ ID NO: 954 - protein, 292 aa, synthetic construct; identical to SEQ ID NO: 950

SEQ ID NO: 955 - protein, 333 aa, synthetic construct; identical to SEQ ID NO: 771

SEQ ID NO: 956 - protein, 333 aa, synthetic construct; identical to SEQ ID NO: 771

SEQ ID NO: 957 - protein, 321 aa, synthetic construct
RDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 958 - protein, 292 aa, synthetic construct
VTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKQGSKDPRGGIFDAVFTRGDQSKLLTSRHDFKEKNLKQISDLIKKELTEGKALGLSHTYANVRINHVINLWGADFDSNGNLKAIYVTDSDSNASIGMKKYFVGVNSAGKVAISAKEIKQDNIGAQVLGLFTLSTGQQSWNQTN

SEQ ID NO: 959 - protein, 292 aa, synthetic construct
VTSVWTKGVTPPANFTQGEDVFHAPYVANQGWYDITKTFNGKDTLLCGAATAGNMLHWWFDQNKDQIKRYLEEHPEKQKINFKGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYVVGVNKAGKVAISAKEIKEDNIGAQVLGLFTLSTGQDSWNQTN

SEQ ID NO: 960 - protein, 292 aa, synthetic construct
VTSVWTKGVTPPANFTQGEDVFHAPYVANQGWYDITKTFNGKDTLLCGAATAGNMLHWWFDQNKDQIKRYLEEHPEKQKINFKGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNKAGKVAISAKEIKEDNIGAQVLGLFTLSTGQDSWNQTN

SEQ ID NO: 961 - protein, 292 aa, synthetic construct
VTSVWTKGVTPPANFTQGEDVFHAPYVANQGWYDITKLFNGKDTLLCGAATAGNMLHWWFDQNKDQIKRYLEEHPEKQKINFKGEQLFDVKEAIDTKNHQLDSKLFEYFLEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNKAGKVAISAKEIKEDNIGAQVLGLFTLSTGQDSWNQTN

SEQ ID NO: 962 - protein, 292 aa, synthetic construct
VTSVWTKGVTPPANFTQGEDVFHAPYVANQGWYDITKTFNGKDTLLCGAATAGNMLHWWFDQNKDQIKRYLEEHPEKQKINFNGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYVVGVNSAGKVAISAKEIKEDNIGAQVLGLFTLSTGQDSWNQTN

SEQ ID NO: 963 - protein, 292 aa, synthetic construct
VTSVWTKGVTPPANFTQGEDVFHAPYVANQGWYDITKTFNGKDTLLCGAATAGNMLHWWFDQNKDQIKRYLEEHPEKQKINFNGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNSAGKVAISAKEIKEDNIGAQVLGLFTLSTGQDSWNQTN

SEQ ID NO: 964 - protein, 292 aa, synthetic construct
VTSVWTKGVTPPANFTQGEDVFHAPYVANQGWYDITKLFNGKDTLLCGAATAGNMLHWWFDQNKDQIKRYLEEHPEKQKINFNGEQLFDVKEAIDTKNHQLDSKLFEYFLEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNSAGKVAISAKEIKEDNIGAQVLGLFTLSTGQDSWNQTN

SEQ ID NO: 965 - protein, 294 aa, synthetic construct
VTSVWTKGVTPPAKFTQGEDVFHAPYKANQGWYDITKTFNGKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVGINHVINLWGADFDSNGNLKAIYVTDSDTNASIGMKKYVVGVNSAGKVAISAKEIKEDNIGAQVLGLFTLSTGQDSWNQTN

SEQ ID NO: 966 - protein, 294 aa, synthetic construct
VTSVWTKGVTPPAKFTQGEDVFHAPYKANQGWYDITKTFNGKDNLLCGAATAGNMLHWWFDQNKEKIEAYLKKHPDKQKIIFGDQELLDVRKVINTKGDQTNSELFNYFRDKAFPTLSARRIGVFPDLVLDMFINGYYLNVYKTQTTDVNRTYQEKDRRGGIFDAVFTRGVQSKLLTSRHDFKEKNLKEISDLIKKELTEGKALGLSHTTANVGINHVINLWGADFDSNGNLKAIYVTDSDTNASIGMKKYVVGVNSAGKVAISAKEIKEDNIGAQVLGLFTLSTGQDSWNQTN

SEQ ID NO: 967 - protein, 294 aa, synthetic construct
VTSVWTKGVTPPAKFTQGEDVFHAPYKANQGWYDITKTFNRKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVGINHVINLWGADFDSNGNLKAIYVTDSDTRASIGMKKYVVGVNAAGKVAISAKEIKEDNIGAQVLGLFTLSTGQDSWNQTN

SEQ ID NO: 968 - protein, 294 aa, synthetic construct
VTSVWTKGVTPPAKFTQGEDVFHAPYKANQGWYDITKTFNRKDNLLCGAATAGNMLHWWFDQNKEKIEAYLKKHPDKQKIIFGDQELLDVRKVINTKGDQTNSELFNYFRDKAFPTLSARRIGVFPDLVLDMFINGYYLNVYKTQTTDVNRTYQEKDRRGGIFDAVFTRGVQSKLLTSRHDFKEKNLKEISDLIKKELTEGKALGLSHTTANVGINHVINLWGADFDSNGNLKAIYVTDSDTRASIGMKKYVVGVNAAGKVAISAKEIKEDNIGAQVLGLFTLSTGQDSWNQTN

SEQ ID NO: 969 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVMPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 970 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVMPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 971 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVMPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDANASIGMKKYAVGINAHGHVAISAKKIEGENIGAQVLGLFTLSSGKDQWQKLS

SEQ ID NO: 972 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 973 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 974 - protein, 298 aa, synthetic construct
QITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDANASIGMKKYAVGINAHGHVAISAKKIEGENIGAQVLGLFTLSSGKDQWQKLS

SEQ ID NO: 975 - protein, 298 aa, synthetic construct
QITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYAVGINAHGHVAISAKKIEGENIGAQVLGLFTLSSGKDIWQKLS

SEQ ID NO: 976 - protein, 298 aa, synthetic construct
QITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYAVGINAHGHVAISAKKIEGENIGAQVLGLFTLSSGKDIWQKLS

SEQ ID NO: 977 - protein, 298 aa, synthetic construct
QITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDTRASIGMKKYAVGINAHGHVAISAKKIEGENIGAQVLGLFTLSSGKDQWQKLS

SEQ ID NO: 978 - protein, 333 aa, synthetic construct
SQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 979 - protein, 333 aa, synthetic construct
SQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 980 - protein, 333 aa, synthetic construct
SQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 981 - protein, 333 aa, synthetic construct
SQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDEQLKLSDFLNTYESDHGYRDKSKLFDFISENFNKPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 982 - protein, 292 aa, synthetic construct
VTSVWTKGVTPPTNFTYGEDVLHAPYVANQGWYDITKTFNGKDTLLCGAATAGNMLHWWFDQNKEQIENYLKKHPEKQKINFKGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNKNGKVAISAKEIEEDNIGAQVLGLFTLSTGQDIWNQTN

SEQ ID NO: 983 - protein, 292 aa, synthetic construct
VTSVWTKGVTPPTNFTYGEDVLHAPYVANQGWYDITKTFNGKDTLLCGAATAGNMLHWWFDQNKEQIENYLKKHPEKQKINFKGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 984 - protein, 292 aa, synthetic construct
VTSVWTKGVTPPTNFTYGEDVLHAPYVANQGWYDITKLFNGKDTLLCGAATAGNMLHWWFDQNKEQIENYLKKHPEKQKINFKGEQLFDVKEAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 985 - protein, 292 aa, synthetic construct
VTSVWTKGVTPPTNFTYGEDVLHAPYVANQGWYDITKTFNGKDTLLCGAATAGNMLHWWFDQNKEQIENYLKKHPEKQKINFNGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNSNGKVAISAKEIEEDNIGAQVLGLFTLSTGQDIWNQTN

SEQ ID NO: 986 - protein, 292 aa, synthetic construct
VTSVWTKGVTPPTNFTYGEDVLHAPYVANQGWYDITKTFNGKDTLLCGAATAGNMLHWWFDQNKEQIENYLKKHPEKQKINFNGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 987 - protein, 292 aa, synthetic construct
VTSVWTKGVTPPTNFTYGEDVLHAPYVANQGWYDITKLFNGKDTLLCGAATAGNMLHWWFDQNKEQIENYLKKHPEKQKINFNGEQLFDVKEAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 988 - protein, 292 aa, synthetic construct
VTSVWTKGVTPPTDFIYGEDVLHAPYKAGQGWYDITKTFNGKDTLLCGAATAGNMLHWWFDQNKEQIENYLKKHPEKQKIIFKNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNKNGKVAISAKEIEEDNIGAQVLGLFTLSTGQDIWNQTN

SEQ ID NO: 989 - protein, 292 aa, synthetic construct
VTSVWTKGVTPPTDFIYGEDVLHAPYKAGQGWYDITKTFNGKDTLLCGAATAGNMLHWWFDQNKEQIENYLKKHPEKQKIIFKNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 990 - protein, 292 aa, synthetic construct
VTSVWTKGVTPPTDFIYGEDVLHAPYKAGQGWYDITKLFNGKDTLLCGAATAGNMLHWWFDQNKEQIENYLKKHPEKQKIIFKNQELFDLKAAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 991 - protein, 292 aa, synthetic construct
VTSVWTKGVTPPTDFIYGEDVLHAPYKAGQGWYDITKTFNGKDTLLCGAATAGNMLHWWFDQNKEQIENYLKKHPEKQKIIFNNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNSNGKVAISAKEIEEDNIGAQVLGLFTLSTGQDIWNQTN

SEQ ID NO: 992 - protein, 292 aa, synthetic construct
VTSVWTKGVTPPTDFIYGEDVLHAPYKAGQGWYDITKTFNGKDTLLCGAATAGNMLHWWFDQNKEQIENYLKKHPEKQKIIFNNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 993 - protein, 292 aa, synthetic construct
VTSVWTKGVTPPTDFIYGEDVLHAPYKAGQGWYDITKLFNGKDTLLCGAATAGNMLHWWFDQNKEQIENYLKKHPEKQKIIFNNQELFDLKAAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 994 - protein, 294 aa, synthetic construct
VTSVWTKGVTPPADFTQGEDVFHAPYKANQGWYDITKTFNGKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVGINHVINLWGADFDSDGNLKAIYVTDSDTNASIGMKKYVVGVNSAGKVAISAKEIKEDNIGAQVLGLFTLSTGQDIWNQTN

SEQ ID NO: 995 - protein, 294 aa, synthetic construct
VTSVWTKGVTPPADFTQGEDVFHAPYKANQGWYDITKTFNGKDNLLCGAATAGNMLHWWFDQNKEYIEAYLKKHPEKQKIIFGDQELLDVRKAINTKGSQKNSELFNYFRDKAFPTLSARRLGVFPDLVLDMFINGYYLNVTKTQTTDVNRTYQEKDKRGGIFDAVFTRGVQSKLLTSRHDFKEKGLKEISDLIKQELTEGKALGLSHTTANVGINHVINLWGADFDSDGNLKAIYVTDSDTNASIGMKKYVVGVNSAGKVAISAKEIKEDNIGAQVLGLFTLSTGQDIWNQTN

SEQ ID NO: 996 - protein, 294 aa, synthetic construct
VTSVWTKGVTPPADFTQGEDVFHAPYKANQGWYDITKTFNRKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVGINHVINLWGADFDSDGNLKAIYVTDSDTRASIGMKKYVVGVNAAGKVAISAKEIKEDNIGAQVLGLFTLSTGQDIWNQTN

SEQ ID NO: 997 - protein, 294 aa, synthetic construct
VTSVWTKGVTPPADFTQGEDVFHAPYKANQGWYDITKTFNRKDNLLCGAATAGNMLHWWFDQNKEYIEAYLKKHPEKQKIIFGDQELLDVRKAINTKGSQKNSELFNYFRDKAFPTLSARRLGVFPDLVLDMFINGYYLNVTKTQTTDVNRTYQEKDKRGGIFDAVFTRGVQSKLLTSRHDFKEKGLKEISDLIKQELTEGKALGLSHTTANVGINHVINLWGADFDSDGNLKAIYVTDSDTRASIGMKKYVVGVNAAGKVAISAKEIKEDNIGAQVLGLFTLSTGQDIWNQTN

SEQ ID NO: 998 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVMPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 999 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1000 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANASIGMKKYAVGVNANGKVAISAKKIEGDNIGAQVLGLFTLSTGQDQWQKLS

SEQ ID NO: 1001 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1002 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1003 - protein, 298 aa, synthetic construct
TITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANASIGMKKYAVGVNANGKVAISAKKIEGDNIGAQVLGLFTLSTGQDQWQKLS

SEQ ID NO: 1004 - protein, 298 aa, synthetic construct
TITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYAVGVNANGKVAISAKKIEGDNIGAQVLGLFTLSTGQDIWQKLS

SEQ ID NO: 1005 - protein, 298 aa, synthetic construct
TITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYAVGVNANGKVAISAKKIEGDNIGAQVLGLFTLSTGQDIWQKLS

SEQ ID NO: 1006 - protein, 298 aa, synthetic construct
TITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDTRASIGMKKYAVGVNANGKVAISAKKIEGDNIGAQVLGLFTLSTGQDQWQKLS

SEQ ID NO: 1007 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVMPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1008 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1009 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDANASIGMKKYAVGINAHGKVAISAKKIEGDNIGAQVLGLFTLSTGQDQWQKLS

SEQ ID NO: 1010 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1011 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1012 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDANASIGMKKYAVGINAHGKVAISAKKIEGDNIGAQVLGLFTLSTGQDQWQKLS

SEQ ID NO: 1013 - protein, 298 aa, synthetic construct
TITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDTRASIGMKKYAVGINAHGKVAISAKKIEGDNIGAQVLGLFTLSTGQDIWQKLS

SEQ ID NO: 1014 - protein, 298 aa, synthetic construct
TITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDTRASIGMKKYAVGINAHGKVAISAKKIEGDNIGAQVLGLFTLSTGQDIWQKLS

SEQ ID NO: 1015 - protein, 298 aa, synthetic construct
TITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDTRASIGMKKYAVGINAHGKVAISAKKIEGDNIGAQVLGLFTLSTGQDQWQKLS

SEQ ID NO: 1016 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1017 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1018 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDEQLKLSDFLNTYESDDGYRDKSKLFDFISNNFNKPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1019 - protein, 333 aa, synthetic construct
SQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDEQLKLSDFLNTYESDDGYRDKSKLFDFISENFNKPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1020 - protein, 16 aa, synthetic construct
GGGGSGGGGSGGGGSG

SEQ ID NO: 1021 - protein, 21 aa, synthetic construct
GGGGSGGGGSGGGGSGGGGSG

SEQ ID NO: 1022 - protein, 11 aa, synthetic construct
GGGGSGGGGSG

SEQ ID NO: 1023 - protein, 518 aa, synthetic construct
VTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1024 - protein, 520 aa, synthetic construct
VTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1025 - protein, 524 aa, synthetic construct
QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1026 - protein, 559 aa, synthetic construct
SQTEDSESLQRLRDIEDFQAEKKMQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1027 - protein, 518 aa, synthetic construct
VTSVWTKGVTPPANFTQGEDVFHAPYKANQGWYDITKTFNGKDDLLCGAATAGNMLHWWFDQNKDQIEAYLKEHPEKQKINFNGEQMFDVKEAIDTKDDQTNSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALALSHTYANVRINHVINLWGADFDSNGNLEAIYVTDSDSNASIGMKKYFVGVNSAGKVAISAKEIEDDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1028 - protein, 518 aa, synthetic construct
VTSVWTKGVTPPANFTQGEDVFHAPYVANQGWYDITKTFNGKDDLLCGAATAGNMLHWWFDQNKDQIERYLKEHPEKQKINFNGEQMFDVKEAIDTKDSQTDSKLFEYFKEKAFPYLSTKHLGVFPDHVLDMFINGYRLSLTNHGPTPVKEGSKDPRGGIFDAVFTRGDQSKLLTSRHDFKEKTLKEISDLIKQELTEGKALGLSHTYANVRINHVINLWGADFDSEGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1029 - protein, 518 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1030 - protein, 520 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1031 - protein, 520 aa, synthetic construct
ITSVWTKGVTPPAKFTQGEDVFHAPYVANQGWYDITKTFNGKDDLLCGAATAGNMLHWWFDQNKEEIEAYLKKHPEKQKIMFGDQELLDVRKVINTKDSQTNSALFNYFKDKAFPNLSARRLGVMPDLVLDMFINGYYLNVYKTQTTDVNRTYQTKDRRGGIFDAVFTRGDQSKLLTERHDFKEKTLKEISDLIKQELTEGKALGLSHTYANVRINHVINLWGADFDSNGNLEAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1032 - protein, 524 aa, synthetic construct
TITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1033 - protein, 524 aa, synthetic construct
QITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKTLNDISTLIKQELTEGKALALSHTYANVSISHVINLWGADFNAEGNLEAIYVTDSDANASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1034 - protein, 524 aa, synthetic construct
QITSVWTKGVTPLTPEQFRYNNEDVIHAPYLANQGWYDITKTFNGKDNLLCGAATAGNMLHWWFDQNKTEIEAYLKKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNEISTLIKQELTEGKALALSHTYANVSISHVINLWGADFNAEGNLEAIYVTDSDSNASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1035 - protein, 524 aa, synthetic construct
QITSVWTKGVTPPTPEQFRYNNEDVFHAPYTAHQGWYDITKTFDGKDNLLCGAATAGNMLHWWFDQNKTEIEAYLSKHPEKQKIIFNNQELFDLKAAIDTKDSQTNSALFNYFRDKAFPNLSARQLGVMPDLVLDMFINGYYLNVFKTQSTDVNRPYQDKDKRGGIFDAVFTRGDQTTLLTARHDLKNKTLNDISTIIKQELTEGRALALSHTYANVSISHVINLWGADFNAEGNLEAIYVTDSDSNASIGMKKYFVGVNASGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1036 - protein, 559 aa, synthetic construct
SQTEDSESLQRLRDIEDFQAEKKKQNVVYTKWLDGVDVKDHDFRKIVDGNIAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1037 - protein, 559 aa, synthetic construct
SQTEDSESLQRLRDIEDFQAEKKKQNVVYTKWLDGVDVKDHDFRKIVDGNIAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1038 - protein, 518 aa, synthetic construct
VTSVWTKGVTPPANFTQGEDVFHAPYVANQGWYDITKTFNGKDNLLCGAATAGNMLHWWFDQNKDQIKRYLEEHPEKQKINFNGEQLFDVKEAIDTKNHQLDSKLFEYFKEKAFPYLSTKHLGVFPDHVIDMFINGYRLSLTNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1039 - protein, 520 aa, synthetic construct
VTSVWTKGVTPPAKFTQGEDVFHAPYVANQGWYDITKTFNGKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVRINHVINLWGADFDSNGNLKAIYVTDSDTNASIGMKKYFVGVNSAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1040 - protein, 524 aa, synthetic construct
QITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYFVGINAHGHVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1041 - protein, 559 aa, synthetic construct
SQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1042 - protein, 518 aa, synthetic construct
VTSVWTKGVTPPANFTQGEDVFHAPYVANQGWYDITKTFNRKDNLLCGAATAGNMLHWWFDQNKDQIKRYLEEHPEKQKINFKGEQLFDVKEAIDTKNHQLDSKLFEYFKEKAFPYLSTKHLGVFPDHVIDMFINGYRLSLTNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYFVGVNKAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1043 - protein, 520 aa, synthetic construct
VTSVWTKGVTPPAKFTQGEDVFHAPYVANQGWYDITKTFNRKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVRINHVINLWGADFDSNGNLKAIYVTDSDTRASIGMKKYFVGVNAAGKVAISAKEIKEDNIGAQVLGLFTLSTGQDSWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1044 - protein, 524 aa, synthetic construct
QITSVWTKGVTPLTPEQFRYYNEDVIHAPYLAHQGWYDITKAFDGKDNLLCGAATAGNMLHWWFDQNKTEIEAYLSKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYFVGINAHGHVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1045 - protein, 559 aa, synthetic construct
SQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1046 - protein, 518 aa, synthetic construct
VTSVWTKGVTPPANFTQGEDVFHAPYKANQGWYDITKTFNGKDNLLCGAATAGNMLHWWFDQNKDQIEAYLKEHPEKQKINFNGEQLFDVKEAIDTKDDQTNSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALALSHTYANVRINHVINLWGADFDSNGNLEAIYVTDSDTNASIGMKKYFVGVNSAGKVAISAKEIEDDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1047 - protein, 518 aa, synthetic construct
VTSVWTKGVTPPANFTQGEDVFHAPYVANQGWYDITKTFNGKDNLLCGAATAGNMLHWWFDQNKDQIERYLKEHPEKQKINFNGEQLFDVKEAIDTKDSQTDSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALGLSHTYANVRINHVINLWGADFDSEGNLKAIYVTDSDTNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1048 - protein, 518 aa, synthetic construct
VTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1049 - protein, 520 aa, synthetic construct
VTSVWTKGVTPPADFTQGEDVFHAPYVANQGWYDITKTFNGKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDTNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1050 - protein, 520 aa, synthetic construct
ITSVWTKGVTPPAKFTQGEDVFHAPYVANQGWYDITKTFNGKDNLLCGAATAGNMLHWWFDQNKEEIEAYLKKHPEKQKIIFGDQELLDVRKVINTKDSQTNSALFNYFKDKAFPNLSARRLGVFPDLVLDMFINGYYLNVYKTQTTDVNRTYQTKDRRGGIFDAVFTRGVQSKLLTERHDFKEKTLKEISDLIKQELTEGKALGLSHTYANVRINHVINLWGADFDSNGNLEAIYVTDSDTNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1051 - protein, 524 aa, synthetic construct
TITSVWTKGVTPPTPEDFRYNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSTGQDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1052 - protein, 524 aa, synthetic construct
QITSVWTKGVTPPTPEQFRYNNEDVIHAPYLANQGWYDITKTFNGKDNLLCGAATAGNMLHWWFDQNKTEIEAYLSKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKTLNDISTLIKQELTEGKALALSHTYANVRISHVINLWGADFNAEGNLEAIYVTDSDANASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1053 - protein, 524 aa, synthetic construct
QITSVWTKGVTPLTPEQFRYNNEDVIHAPYLANQGWYDITKTFNGKDNLLCGAATAGNMLHWWFDQNKTEIEAYLKKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNEISTLIKQELTEGKALALSHTYANVRISHVINLWGADFNAEGNLEAIYVTDSDSNASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1054 - protein, 524 aa, synthetic construct
QITSVWTKGVTPPTPEQFRYNNEDVFHAPYTAHQGWYDITKTFDGKDNLLCGAATAGNMLHWWFDQNKTEIEAYLSKHPEKQKIIFNNQELFDLKAAIDTKDSQTNSALFNYFRDKAFPGLSARQLGVFPDLVLDMFINGYYLNVFKTQSTDVNRPYQDKDKRGGIFDAVFTRGVQTTLLTARHDLKNKTLNDISTIIKQELTEGRALALSHTYANVRISHVINLWGADFNAEGNLEAIYVTDSDSNASIGMKKYFVGVNASGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1055 - protein, 559 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1056 - protein, 559 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1057 - protein, 518 aa, synthetic construct
VTSVWTKGVTPPANFTQGEDVFHAPYKANQGWYDITKTFNRKDNLLCGAATAGNMLHWWFDQNKDQIEAYLKEHPEKQKINFKGEQLFDVKEAIDTKDDQTNSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALALSHTYANVRINHVINLWGADFDSNGNLEAIYVTDSDTEASIGMKKYFVGVNKAGKVAISAKEIEDDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1058 - protein, 518 aa, synthetic construct
VTSVWTKGVTPPANFTQGEDVFHAPYVANQGWYDITKTFNRKDNLLCGAATAGNMLHWWFDQNKDQIERYLKEHPEKQKINFKGEQLFDVKEAIDTKDSQTDSKLFEYFKEKAFPYLSTKHLGVFPDHVLDMFINGYRLSLTNHGPTPVKEGSKDKRGGIFDAVFTRGVQSKLLTSRHDFKEKTLKEISDLIKQELTEGKALGLSHTYANVRINHVINLWGADFDSEGNLKAIYVTDSDTEASIGMKKYFVGVNKAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1059 - protein, 518 aa, synthetic construct
VTSVWTKGVTPPTNFTYGEDVLHAPYVANQGWYDITKTFNRKDNLLCGAATAGNMLHWWFDQNKEQIENYLKKHPEKQKINFKGEQLFDVKEAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYFVGVNKNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1060 - protein, 520 aa, synthetic construct
VTSVWTKGVTPPADFTQGEDVFHAPYVANQGWYDITKTFNRKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDTRASIGMKKYFVGVNAAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1061 - protein, 520 aa, synthetic construct
ITSVWTKGVTPPAKFTQGEDVFHAPYVANQGWYDITKTFNRKDNLLCGAATAGNMLHWWFDQNKEEIEAYLKKHPEKQKIIFGDQELLDVRKVINTKDSQTNSALFNYFKDKAFPNLSARRLGVFPDLVLDMFINGYYLNVYKTQTTDVNRTYQTKDRRGGIFDAVFTRGVQSKLLTERHDFKEKTLKEISDLIKQELTEGKALGLSHTYANVRINHVINLWGADFDSNGNLEAIYVTDSDTRASIGMKKYFVGVNAAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1062 - protein, 524 aa, synthetic construct
TITSVWTKGVTPPTPEDFRYYNEDVLHAPYVANQGWYDITKTFDGKDNLLCGAATAGNMLHWWFDQNKEEIERYLKKHPEKQKIIFKNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYFVGVNANGKVAISAKKIEGDNIGAQVLGLFTLSTGQDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1063 - protein, 524 aa, synthetic construct
QITSVWTKGVTPPTPEQFRYYNEDVIHAPYLANQGWYDITKTFNGKDNLLCGAATAGNMLHWWFDQNKTEIEAYLSKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKTLNDISTLIKQELTEGKALALSHTYANVRISHVINLWGADFNAEGNLEAIYVTDSDTRASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1064 - protein, 524 aa, synthetic construct
QITSVWTKGVTPLTPEQFRYYNEDVIHAPYLANQGWYDITKTFNGKDNLLCGAATAGNMLHWWFDQNKTEIEAYLKKHPEKQKIIFKNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNEISTLIKQELTEGKALALSHTYANVRISHVINLWGADFNAEGNLEAIYVTDSDSRASIGMKKYFVGVNAHGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1065 - protein, 524 aa, synthetic construct
QITSVWTKGVTPPTPEQFRYYNEDVFHAPYTAHQGWYDITKTFDGKDNLLCGAATAGNMLHWWFDQNKTEIEAYLSKHPEKQKIIFKNQELFDLKAAIDTKDSQTNSALFNYFRDKAFPGLSARQLGVFPDLVLDMFINGYYLNVFKTQSTDVNRPYQDKDKRGGIFDAVFTRGVQTTLLTARHDLKNKTLNDISTIIKQELTEGRALALSHTYANVRISHVINLWGADFNAEGNLEAIYVTDSDSRASIGMKKYFVGVNASGKVAISAKKIEGENIGAQVLGLFTLSSGKDIWQKLSDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1066 - protein, 559 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDRNRDNVDRFLRQNPEKHGIIELPDEQLKLSDFLNTYESDDGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1067 - protein, 559 aa, synthetic construct
SQTEDSESLQRLRDIEDFQAEKKKQNVVYTKWLDGVDVKDHDFRKIVDGNIAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNYKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1068 - protein, 518 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1069 - protein, 518 aa, synthetic construct
VTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1070 - protein, 522 aa, synthetic construct
VTSVWTKGVTPPTDFRKIVDGNIAYYHAPYKAGQGWYDITKAFDGGDDLLCGAATAGNMLHWWFDQNKEQIENYLKKHPEKQKINFNGEQMFDVKEAIDTKDSQTNSELFNYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1071 - protein, 518 aa, synthetic construct
VTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1072 - protein, 518 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1073 - protein, 518 aa, synthetic construct
VTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1074 - protein, 518 aa, synthetic construct
VTSVWTKGVTPPTDFIYGEDVLHAPYKAGQGWYDITKAFDGGDNLLCGAATAGNMLHWWFDQNKEQIENYLKKHPEKQKIIFNNQELFDLKAAIDTKDSQTNSELFNYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1075 - protein, 518 aa, synthetic construct
VTSVWTKGVTPPTNFTYGEDVLHAPYVANQGWYDITKTFNGKDNLLCGAATAGNMLHWWFDQNKEQIENYLKKHPEKQKIIFNNQELFDLKAAIDTKDSQLDSKLFEYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSNGKVAISAKEIEEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1076 - protein, 520 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1077 - protein, 520 aa, synthetic construct
VTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1078 - protein, 520 aa, synthetic construct
VTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1079 - protein, 520 aa, synthetic construct
VTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1080 - protein, 520 aa, synthetic construct
VTSVWTKGVTPPTDFIKGEDVFHAPYKAGQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1081 - protein, 520 aa, synthetic construct
VTSVWTKGVTPPADFTQGEDVFHAPYVANQGWYDITKTFNGKDNLLCGAATAGNMLHWWFDQNKEYIEAYLKKHPEKQKIIFNNQELFDLKAAINTKGSQKNSELFNYFRDKAFPNLSARRLGVFPDLVLDMFINGYYLNVTKTQTTDVNRTYQEKDKRGGIFDAVFTRGVQSKLLTSRHDLKNKGLKEISDLIKQELTEGKALGLSHTYANVRINHVINLWGADFDSDGNLKAIYVTDSDSNASIGMKKYFVGVNSAGKVAISAKEIKEDNIGAQVLGLFTLSTGQDIWNQTNDKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1082 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSSGKVAISAKEIKEDNIGAQVLGLFTLSTGQDSWNQTN

SEQ ID NO: 1083 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 1084 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIYVTDSDSNPSIGMKKYFVGVNSSGKVAISAKEIKEDNIGAQVLGLFTLSTGQDSWNQTN

SEQ ID NO: 1085 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 1086 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPNLSTKHLGVFPDHVIDMFINGYRLSLLNHGPTPVKEGSKDPRGGIFDAVFTRGDQSKLLTSRHDFKEKNLKEISDLIKKELTEGKALGLSHTYANGRINHVINLWGADFDSNGNLKAIAVTDSDSNASIGMKKYFVGVNSSGKVAISAKEIKEDNIGAQVLGLFTLSTGQDSWNQTN

SEQ ID NO: 1087 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFDYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNPSIGMKKYFVGVNSSGKVAISAKEIKEDNIGAQVLGLFTLSTGQDSWNQTN

SEQ ID NO: 1088 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDDLLCGAATAGNMLHWWFDQNKDQIKRYLEEHPEKQKINFNGEQMFDVKEAIDTKNHQLDSKLFEYFLEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIAVTDSDSNASIGMKKYFVGVNSSGKVAISAKEIKEDNIGAQVLGLFTLSTGQDSWNQTN

SEQ ID NO: 1089 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 1090 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1091 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1092 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 1093 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 1094 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYFVGVNSDGKVAISAKEIEEDNIGAQVLGLFTLSTGQDIWNQTN

SEQ ID NO: 1095 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNKSIGMKKYPVGVNSNGKVAISAKEIEEDNIGAQVLGLFTLSTGQDIWNQTN

SEQ ID NO: 1096 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 1097 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDFKEKTLKEISDLIKQELTEGKALGISHTYANVGINHVINLWGADFDAEGNLEAIAVTDSDSNASIGMKKYFVGVNSSGKVAISAKEIEEDNIGAQVLGLFTLSTGQDIWNQTN

SEQ ID NO: 1098 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1099 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDFKEKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 1100 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 1101 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 1102 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 1103 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 1104 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPNLSTKHLGVFPDHVIDMFINGYRLSLLNHGPTPVKRGSKDKRGGIFDAVFTRGVQSKLLTNRHDFKEKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 1105 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFDYFKEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 1106 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDNLLCGAATAGNMLHWWFDQNKEQIENYLKKHPEKQKINFNGEQLFDVKEAIDTKDSQLDSKLFEYFLEKAFPYLSTKHLGVFPDHVIDMFINGYRLSLTNHGPTPVKRGSKDKRGGIFDAVFTRGVQSKLLTNRHDFKEKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 1107 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNASIGMKKYFVGVNSSGKVAISAKEIEEDNIGAQVLGLFTLSTGQDIWNQTN

SEQ ID NO: 1108 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1109 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1110 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 1111 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPNLSTKHLGVFPDHVIDMFINGYRLSLLNHGPTPVKRGSKDPRGGIFDAVFTRGDQSKLLTNRHDLKNKTLKEISDLIKQELTEGKALGISHTYANGRINHVINLWGADFDAEGNLEAIAVTDSDSNASIGMKKYFVGVNSSGKVAISAKEIEEDNIGAQVLGLFTLSTGQDIWNQTN

SEQ ID NO: 1112 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFDYFKEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1113 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDDLLCGAATAGNMLHWWFDQNKEQIENYLKKHPEKQKINFNGEQMFDVKEAIDTKDSQLDSKLFEYFLEKAFPYLSTKHLGVFPDHVIDMFINGYRLSLTNHGPTPVKRGSKDPRGGIFDAVFTRGDQSKLLTNRHDLKNKTLKEISDLIKQELTEGKALGISHTYANVRINHVINLWGADFDAEGNLEAIAVTDSDSNASIGMKKYFVGVNSSGKVAISAKEIEEDNIGAQVLGLFTLSTGQDIWNQTN

SEQ ID NO: 1114 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNASIGMKKYFVGVNSSGKVAISAKEIEEDNIGAQVLGLFTLSTGQDIWNQTN

SEQ ID NO: 1115 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 1116 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIYVTDSDTNPSIGMKKYFVGVNSSGKVAISAKEIEEDNIGAQVLGLFTLSTGQDIWNQTN

SEQ ID NO: 1117 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 1118 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPNLSTKHLGVFPDHVIDMFINGYRLSLLNHGPTPVKRGSKDKRGGIFDAVFTRGVQSKLLTNRHDLKNKTLKEISDLIKQELTEGKALGISHTYANGRINHVINLWGADFDAEGNLEAIAVTDSDTNASIGMKKYFVGVNSSGKVAISAKEIEEDNIGAQVLGLFTLSTGQDIWNQTN

SEQ ID NO: 1119 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFDYFKEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIYVTDSDTNPSIGMKKYFVGVNSSGKVAISAKEIEEDNIGAQVLGLFTLSTGQDIWNQTN

SEQ ID NO: 1120 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDNLLCGAATAGNMLHWWFDQNKEQIENYLKKHPEKQKIIFNNQELFDLKAAIDTKDSQLDSKLFEYFLEKAFPYLSTKHLGVFPDHVIDMFINGYRLSLTNHGPTPVKRGSKDKRGGIFDAVFTRGVQSKLLTNRHDLKNKTLKEISDLIKQELTEGKALGISHTYANVRINHVINLWGADFDAEGNLEAIAVTDSDTNASIGMKKYFVGVNSSGKVAISAKEIEEDNIGAQVLGLFTLSTGQDIWNQTN

SEQ ID NO: 1121 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVGINHVINLWGADFDSNGNLKAIYVTDSDSNASIGMKKYFVGVNSSGKVAISAKEIKEDNIGAQVLGLFTLSTGQDSWNQTN

SEQ ID NO: 1122 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYFVGVNSSGKVAISAKEIKEDNIGAQVLGLFTLSTGQDSWNQTN

SEQ ID NO: 1123 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYFVGVNSSGKVAISAKEIKEDNIGAQVLGLFTLSTGQDSWNQTN

SEQ ID NO: 1124 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSAGKVAISAKEIKEDNIGAQVLGLFTLSTGQDSWNQTN

SEQ ID NO: 1125 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRLNHVINLWGADFDSNGNLKAIYVTDSDSNASIGMKKYGVGVNSAGKVAISAKEIKEDNIGAQVLGLFTLSTGQDSWNQTN

SEQ ID NO: 1126 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPGLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYGVGVNSAGKVAISAKEIKEDNIGAQVLGLFTLSTGQDSWNQTN

SEQ ID NO: 1127 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYDANQGWYDITKTFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRISHVINLWGADFDSNGNLKAIYVTDSDSNASIGMKKYFVGVNSSGKVAISAKEIKEDNIGAQVLGLFTLSTGQDSWNQTN

SEQ ID NO: 1128 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 1129 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYDANQGWYDITKEFNGKDDLLCGAATAGNMLHWWFDQNKEKIEAYLKKHPDKQKIMFGDQELLDVRKVINTKGDQTNSELFNYFRDKAFPNLSARRIGVMPDLVLDMFINGYYLNVYKTQTTDVNRTYQEKDRRGGIFDAVFTRGDQSKLLTSRHDFKEKNLKEISDLIKKELTEGKALGLSHTYANVRIGHVINLWGADFDSNGNLKAIYVTDSDSNASIGMKKYGVGVNSAGKVAISAKEIKEDNIGAQVLGLFTLSTGQDSWNQTN

SEQ ID NO: 1130 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 1131 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 1132 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 1133 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 1134 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYVANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 1135 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 1136 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYDANQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 1137 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYVANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 1138 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYDANQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 1139 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVGINHVINLWGADFDSDGNLKAIYVTDSDSNASIGMKKYFVGVNSSGKVAISAKEIKEDNIGAQVLGLFTLSTGQDIWNQTN

SEQ ID NO: 1140 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYFVGVNSSGKVAISAKEIKEDNIGAQVLGLFTLSTGQDIWNQTN

SEQ ID NO: 1141 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYFVGVNSSGKVAISAKEIKEDNIGAQVLGLFTLSTGQDIWNQTN

SEQ ID NO: 1142 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSAGKVAISAKEIKEDNIGAQVLGLFTLSTGQDIWNQTN

SEQ ID NO: 1143 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYKAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRLNHVINLWGADFDSDGNLKAIYVTDSDSNASIGMKKYGVGVNSAGKVAISAKEIKEDNIGAQVLGLFTLSTGQDIWNQTN

SEQ ID NO: 1144 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYGVGVNSAGKVAISAKEIKEDNIGAQVLGLFTLSTGQDIWNQTN

SEQ ID NO: 1145 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYDAGQGWYDITKTFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRISHVINLWGADFDSDGNLKAIYVTDSDSNASIGMKKYFVGVNSSGKVAISAKEIKEDNIGAQVLGLFTLSTGQDIWNQTN

SEQ ID NO: 1146 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYKAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 1147 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIKGEDVFHAPYDAGQGWYDITKEFNGKDDLLCGAATAGNMLHWWFDQNKEYIEAYLKKHPEKQKIMFGDQELLDVRKAINTKGSQKNSELFNYFRDKAFPNLSARRLGVMPDLVLDMFINGYYLNVTKTQTTDVNRTYQEKDKRGGIFDAVFTRGDQSKLLTSRHDFKEKGLKEISDLIKQELTEGKALGLSHTYANVRIGHVINLWGADFDSDGNLKAIYVTDSDSNASIGMKKYGVGVNSAGKVAISAKEIKEDNIGAQVLGLFTLSTGQDIWNQTN

SEQ ID NO: 1148 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRKNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGRNAHGHVAISAKKIEGENIGAQVLGLFTLSSGKDIWQKLS

SEQ ID NO: 1149 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSLGKDIWQKLS

SEQ ID NO: 1150 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 1151 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFDAEGNLEAIYVTDSDANASIGMKKYFVGRNAHGHVAISAKKIEGENIGAQVLGLFTLSSGKDQWQKLS

SEQ ID NO: 1152 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFNNQEWFDLKAAIDTKDSQTNSQLFNYFRDKAFPNLSARQLGVMPDLVLDMFINGYYLNVPKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYAVGINAHGHVAISAKKIEGENIGAQVLGLFTLSSGKDIWQKLS

SEQ ID NO: 1153 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANPSIGMKKYFVGRNAHGHVAISAKKIEGENIGAQVLGLFTLSSGKDIWQKLS

SEQ ID NO: 1154 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 1155 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFDYFRDKAFPNLSARQLGVMPDLVLDMFINGYYLNVGKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDQWQKLS

SEQ ID NO: 1156 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFNNQELFDLKAAIDTKDSQTNSQLFDYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGELEAIYVTDSDANPSIGMKKYFVGRNAHGHVAISAKKIEGENIGAQVLGLFTLSSGKDIWQKLS

SEQ ID NO: 1157 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 1158 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 1159 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRYNNEDVLHAPYVANQGWYDITKTFDGKDNLLCGAATAGNMLHWWFDQNKEEIERYLKKHPEKQKIIFNNQEWFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGVNANGKVAISAKKIEGDNIGAQVLGLFTLSLGQDIWQKLS

SEQ ID NO: 1160 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 1161 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 1162 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDQWQKLS

SEQ ID NO: 1163 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 1164 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1165 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 1166 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 1167 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 1168 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 1169 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRKNNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDIWQKLS

SEQ ID NO: 1170 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSLGQDIWQKLS

SEQ ID NO: 1171 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 1172 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYFVGRNANGKVAISAKKIEGDNIGAQVLGLFTLSTGQDQWQKLS

SEQ ID NO: 1173 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQEWFDVKAAIDTKDSQTNSKLFNYFRDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1174 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANPSIGMKKYFVGRNANGKVAISAKKIEGDNIGAQVLGLFTLSTGQDIWQKLS

SEQ ID NO: 1175 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 1176 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDQWQKLS

SEQ ID NO: 1177 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFNNQELFDVKAAIDTKDSQTNSKLFDYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANPSIGMKKYFVGRNANGKVAISAKKIEGDNIGAQVLGLFTLSTGQDIWQKLS

SEQ ID NO: 1178 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRKNNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDIWQKLS

SEQ ID NO: 1179 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSLGQDIWQKLS

SEQ ID NO: 1180 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 1181 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYFVGRNAHGKVAISAKKIEGDNIGAQVLGLFTLSTGQDQWQKLS

SEQ ID NO: 1182 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFNNQEWFDVKAAIDTKDSQTNSKLFNYFRDKAFPNLSARQLGVMPDLVLDMFINGYYLNLPKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANASIGMKKYAVGVNAHGKVAISAKKIEGDNIGAQVLGLFTLSTGQDIWQKLS

SEQ ID NO: 1183 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGNLEAIYVTDSDANPSIGMKKYFVGRNAHGKVAISAKKIEGDNIGAQVLGLFTLSTGQDIWQKLS

SEQ ID NO: 1184 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 1185 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDQWQKLS

SEQ ID NO: 1186 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFNNQELFDVKAAIDTKDSQTNSKLFDYFRDKAFPNLSARQLGVMPDLVLDMFINGYYLNLGKTQSTDVNRPYQDKDKRGGIFDAVFTRGDQTTLLTARHDLKNKGLNEISDLIKQELTEGKALALSHTYANVSINHVINLWGADFDAEGELEAIYVTDSDANPSIGMKKYFVGRNAHGKVAISAKKIEGDNIGAQVLGLFTLSTGQDIWQKLS

SEQ ID NO: 1187 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1188 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1189 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1190 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGLYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1191 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1192 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1193 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1194 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEMQNVVYTKWLDGVDVKDHDFRKIVDGNSAYYATPLLNGRGWYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1195 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1196 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNEAYYATPLLNGRGFYDINKDFNRDSDKCAAAVAANMFHYWLDINRDNVDRFLRQNPEKHGIIELPDGQLKLSDFLNTYESDHGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1197 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1198 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDPTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1199 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1200 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGLYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1201 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1202 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1203 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1204 - protein, 575 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGWYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDPTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQV

SEQ ID NO: 1205 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDPTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1206 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNEAYYATPLLNGRGFYDINKDFNRDSDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDPTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1207 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1208 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1209 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1210 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNIAYYATPLLNGRGLYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1211 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKDQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1212 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNEFSVLLIEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1213 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1214 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKEKQNVVYTKWLDGVDVKDHDFRKIVDGNSAYYATPLLNGRGWYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNNHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1215 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRTIEDSTKNTSKINFFKEVFNEKILTNNHSIRNQNELSVLLSEALYTGKAIGLSYGPAGLRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1216 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNEAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNYKYGRLIEDSTKNTSKINFFKEVFNEKILTNNHSIRNQNELSVLLSEALYTGKAIGLSYGPAGTRHSLGHIISVWGADLDADGNVVAIYVTDSDDKKLTIGDERVGLKRYKISTDDEGRLRLTAYEETHNTGGQIRGLWTLDTGKQAWADYFDKTEQTGTDQAEQ

SEQ ID NO: 1217 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYVANQGWYDITKTFNGKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVRINHVINLWGADFDSNGNLKAIYVTDSDTNASIGMKKYFVGVNSAGKVAISAKEIKEDNIGAQVLGLFTLSTGQDSWNQTN

SEQ ID NO: 1218 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRYNNEDVIHAPYLAHQGWYDITKAFDGKDNLLCGAATAGNMLHWWFDQNKTEIEAYLSKHPEKQKIIFNNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYFVGINAHGHVAISAKKIEGENIGAQVLGLFTLSSGKDIWQKLS

SEQ ID NO: 1219 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1220 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1221 - protein, 538 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1222 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1223 - protein, 547 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGANQEIRYSEVTPYHVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1224 - protein, 533 aa, synthetic construct
DKTHTAPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1225 - protein, 579 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGSQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1226 - protein, 569 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGSQTEDSESLQRLRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1227 - protein, 567 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGRDIEDFQAEKKMQNVVYTKWLDGVDVKDHDFRKIVDGNIAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNYKYGRTIEDSTKNTSKINFFKEVFNEKILTNNHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQIRGLWTLDTGKYAWADYFDKTEQTGTDQAEQ

SEQ ID NO: 1228 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAQFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKQGSKDPRGGIFDAVFTRGDQSKLLTSRHDFKEKNLKQISDLIKKELTEGKALGLSHTYANVRINHVINLWGADFDSNGNLKAIYVTDSDSNASIGMKKYFVGVNSAGKVAISAKEIKQDNIGAQVLGLFTLSTGQQSWNQTN

SEQ ID NO: 1229 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDTLLCGAATAGNMLHWWFDQNKDQIKRYLEEHPEKQKINFKGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYVVGVNKAGKVAISAKEIKEDNIGAQVLGLFTLSTGQDSWNQTN

SEQ ID NO: 1230 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDTLLCGAATAGNMLHWWFDQNKDQIKRYLEEHPEKQKINFKGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNKAGKVAISAKEIKEDNIGAQVLGLFTLSTGQDSWNQTN

SEQ ID NO: 1231 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDTLLCGAATAGNMLHWWFDQNKDQIKRYLEEHPEKQKINFKGEQLFDVKEAIDTKNHQLDSKLFEYFLEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNKAGKVAISAKEIKEDNIGAQVLGLFTLSTGQDSWNQTN

SEQ ID NO: 1232 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDTLLCGAATAGNMLHWWFDQNKDQIKRYLEEHPEKQKINFNGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANVRINHVINLWGADFDSNGNLKAIYVTDSDTEASIGMKKYVVGVNSAGKVAISAKEIKEDNIGAQVLGLFTLSTGQDSWNQTN

SEQ ID NO: 1233 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKTFNGKDTLLCGAATAGNMLHWWFDQNKDQIKRYLEEHPEKQKINFNGEQLFDVKEAIDTKNHQLDSKLFEYFKEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNSAGKVAISAKEIKEDNIGAQVLGLFTLSTGQDSWNQTN

SEQ ID NO: 1234 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPANFTQGEDVFHAPYVANQGWYDITKLFNGKDTLLCGAATAGNMLHWWFDQNKDQIKRYLEEHPEKQKINFNGEQLFDVKEAIDTKNHQLDSKLFEYFLEKAFPSLSTKHLGVFPDHVIDMFINGYRLSLLNHGPTPVKEGSKDKRGGIFDAVFTRGVQSKLLTSRHDFKEKNLKEISDLIKKELTEGKALGLSHTYANARINHVINLWGADFDSNGNLKAIYVTDSDTEPSIGMKKYVVGVNSAGKVAISAKEIKEDNIGAQVLGLFTLSTGQDSWNQTN

SEQ ID NO: 1235 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYKANQGWYDITKTFNGKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVGINHVINLWGADFDSNGNLKAIYVTDSDTNASIGMKKYVVGVNSAGKVAISAKEIKEDNIGAQVLGLFTLSTGQDSWNQTN

SEQ ID NO: 1236 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYKANQGWYDITKTFNGKDNLLCGAATAGNMLHWWFDQNKEKIEAYLKKHPDKQKIIFGDQELLDVRKVINTKGDQTNSELFNYFRDKAFPTLSARRIGVFPDLVLDMFINGYYLNVYKTQTTDVNRTYQEKDRRGGIFDAVFTRGVQSKLLTSRHDFKEKNLKEISDLIKKELTEGKALGLSHTTANVGINHVINLWGADFDSNGNLKAIYVTDSDTNASIGMKKYVVGVNSAGKVAISAKEIKEDNIGAQVLGLFTLSTGQDSWNQTN

SEQ ID NO: 1237 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYKANQGWYDITKTFNRKDNLLCGAATAGNMLHWWFDQNKEKIEAYLKKHPDKQKIIFGDQELLDVRKVINTKGDQTNSELFNYFRDKAFPGLSARRIGVFPDLVLDMFINGYYLNVYKTQTTDVNRTYQEKDRRGGIFDAVFTRGVQSKLLTSRHDFKEKNLKEISDLIKKELTEGKALGLSHTYANVGINHVINLWGADFDSNGNLKAIYVTDSDTRASIGMKKYVVGVNAAGKVAISAKEIKEDNIGAQVLGLFTLSTGQDSWNQTN

SEQ ID NO: 1238 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPAKFTQGEDVFHAPYKANQGWYDITKTFNRKDNLLCGAATAGNMLHWWFDQNKEKIEAYLKKHPDKQKIIFGDQELLDVRKVINTKGDQTNSELFNYFRDKAFPTLSARRIGVFPDLVLDMFINGYYLNVYKTQTTDVNRTYQEKDRRGGIFDAVFTRGVQSKLLTSRHDFKEKNLKEISDLIKKELTEGKALGLSHTTANVGINHVINLWGADFDSNGNLKAIYVTDSDTRASIGMKKYVVGVNAAGKVAISAKEIKEDNIGAQVLGLFTLSTGQDSWNQTN

SEQ ID NO: 1239 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVMPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 1240 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVMPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 1241 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVMPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDANASIGMKKYAVGINAHGHVAISAKKIEGENIGAQVLGLFTLSSGKDQWQKLS

SEQ ID NO: 1242 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 1243 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDANASIGMKKYAVGINAHGHVAISAKKIEGENIGAQVLGLFTLSSGKDIWQKLS

SEQ ID NO: 1244 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFRENNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDANASIGMKKYAVGINAHGHVAISAKKIEGENIGAQVLGLFTLSSGKDQWQKLS

SEQ ID NO: 1245 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFRDKAFPGLSARQLGVFPDLVLDMFINGYYLNVFKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYAVGINAHGHVAISAKKIEGENIGAQVLGLFTLSSGKDIWQKLS

SEQ ID NO: 1246 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGNLEAIYVTDSDTRASIGMKKYAVGINAHGHVAISAKKIEGENIGAQVLGLFTLSSGKDIWQKLS

SEQ ID NO: 1247 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGQITSVWTKGVTPLTPEQFREYNEDVIHAPYLAHQGWYDITKAFDGKDNLLCGAATAGNMLHWWFDQNKTEIEAYLSKHPEKQKIIFGNQELFDLKAAIDTKDSQTNSQLFNYFLDKAFPGLSARQLGVFPDLVLDMFINGYYLNVPKTQSTDVNRPYQDKDKRGGIFDAVFTRGVQTTLLTARHDLKNKGLNDISTIIKQELTEGRALALSHTYANVRISHVINLWGADFNAEGELEAIYVTDSDTRASIGMKKYAVGINAHGHVAISAKKIEGENIGAQVLGLFTLSSGKDQWQKLS

SEQ ID NO: 1248 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDGQLKLSDFLNTYESDHGYRDKSKLFDFISNNFNGPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1249 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDGQLKLSDFLNTYESDHGYRDKSKLFDFISENFNGPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1250 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDEQLKLSDFLNTYESDHGYRDKSKLFDFISNNFNKPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1251 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKMQNVVYTKWLDGVDVKDHDFRKIVDGNSAYYATPLLNGRGFYDINKDFNRDNDKCAAAVAANMFHYWLDINRDNVDRFLRQNPEKHGIIELPDEQLKLSDFLNTYESDHGYRDKSKLFDFISENFNKPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDENRLRLTAYEETHNTGGQVRGLWTLDTGKYAWADYFDKTEQTGTDQAEQ

SEQ ID NO: 1252 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDTLLCGAATAGNMLHWWFDQNKEQIENYLKKHPEKQKINFKGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNKNGKVAISAKEIEEDNIGAQVLGLFTLSTGQDIWNQTN

SEQ ID NO: 1253 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDTLLCGAATAGNMLHWWFDQNKEQIENYLKKHPEKQKINFKGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 1254 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDTLLCGAATAGNMLHWWFDQNKEQIENYLKKHPEKQKINFKGEQLFDVKEAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 1255 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDTLLCGAATAGNMLHWWFDQNKEQIENYLKKHPEKQKINFNGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNSNGKVAISAKEIEEDNIGAQVLGLFTLSTGQDIWNQTN

SEQ ID NO: 1256 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKTFNGKDTLLCGAATAGNMLHWWFDQNKEQIENYLKKHPEKQKINFNGEQLFDVKEAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 1257 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTNFTYGEDVLHAPYVANQGWYDITKLFNGKDTLLCGAATAGNMLHWWFDQNKEQIENYLKKHPEKQKINFNGEQLFDVKEAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 1258 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDTLLCGAATAGNMLHWWFDQNKEQIENYLKKHPEKQKIIFKNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNKNGKVAISAKEIEEDNIGAQVLGLFTLSTGQDIWNQTN

SEQ ID NO: 1259 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDTLLCGAATAGNMLHWWFDQNKEQIENYLKKHPEKQKIIFKNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 1260 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDTLLCGAATAGNMLHWWFDQNKEQIENYLKKHPEKQKIIFKNQELFDLKAAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNKNGKVAISAKEIEEDNIGAQVLGLFTLSTGQDIWNQTN

SEQ ID NO: 1261 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDTLLCGAATAGNMLHWWFDQNKEQIENYLKKHPEKQKIIFNNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANVRINHVINLWGADFDAEGNLEAIYVTDSDTEASIGMKKYVVGVNSNGKVAISAKEIEEDNIGAQVLGLFTLSTGQDIWNQTN

SEQ ID NO: 1262 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKTFNGKDTLLCGAATAGNMLHWWFDQNKEQIENYLKKHPEKQKIIFNNQELFDLKAAIDTKDSQLDSKLFEYFKEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 1263 - protein, 533 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPTDFIYGEDVLHAPYKAGQGWYDITKLFNGKDTLLCGAATAGNMLHWWFDQNKEQIENYLKKHPEKQKIIFNNQELFDLKAAIDTKDSQLDSKLFEYFLEKAFPSLSTKHLGVFPDHVIDMFINGYRLSLLNHGPTPVKRGSKDKRGGIFDAVFTRGVQSKLLTNRHDFKEKTLKEISDLIKQELTEGKALGISHTYANARINHVINLWGADFDAEGNLEAIYVTDSDTEPSIGMKKYVVGVNSNGKVAISAKEIEEDNIGAQVLGLFTLSTGQDIWNQTN

SEQ ID NO: 1264 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYKANQGWYDITKTFNGKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVGINHVINLWGADFDSDGNLKAIYVTDSDTNASIGMKKYVVGVNSAGKVAISAKEIKEDNIGAQVLGLFTLSTGQDIWNQTN

SEQ ID NO: 1265 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYKANQGWYDITKTFNGKDNLLCGAATAGNMLHWWFDQNKEYIEAYLKKHPEKQKIIFGDQELLDVRKAINTKGSQKNSELFNYFRDKAFPTLSARRLGVFPDLVLDMFINGYYLNVTKTQTTDVNRTYQEKDKRGGIFDAVFTRGVQSKLLTSRHDFKEKGLKEISDLIKQELTEGKALGLSHTTANVGINHVINLWGADFDSDGNLKAIYVTDSDTNASIGMKKYVVGVNSAGKVAISAKEIKEDNIGAQVLGLFTLSTGQDIWNQTN

SEQ ID NO: 1266 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYKANQGWYDITKTFNRKDNLLCGAATAGNMLHWWFDQNKEYIEAYLKKHPEKQKIIFGDQELLDVRKAINTKGSQKNSELFNYFRDKAFPNLSARRLGVFPDLVLDMFINGYYLNVTKTQTTDVNRTYQEKDKRGGIFDAVFTRGVQSKLLTSRHDFKEKGLKEISDLIKQELTEGKALGLSHTYANVGINHVINLWGADFDSDGNLKAIYVTDSDTRASIGMKKYVVGVNAAGKVAISAKEIKEDNIGAQVLGLFTLSTGQDIWNQTN

SEQ ID NO: 1267 - protein, 535 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGVTSVWTKGVTPPADFTQGEDVFHAPYKANQGWYDITKTFNRKDNLLCGAATAGNMLHWWFDQNKEYIEAYLKKHPEKQKIIFGDQELLDVRKAINTKGSQKNSELFNYFRDKAFPTLSARRLGVFPDLVLDMFINGYYLNVTKTQTTDVNRTYQEKDKRGGIFDAVFTRGVQSKLLTSRHDFKEKGLKEISDLIKQELTEGKALGLSHTTANVGINHVINLWGADFDSDGNLKAIYVTDSDTRASIGMKKYVVGVNAAGKVAISAKEIKEDNIGAQVLGLFTLSTGQDIWNQTN

SEQ ID NO: 1268 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVMPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1269 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1270 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANASIGMKKYAVGVNANGKVAISAKKIEGDNIGAQVLGLFTLSTGQDQWQKLS

SEQ ID NO: 1271 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1272 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDANASIGMKKYAVGVNANGKVAISAKKIEGDNIGAQVLGLFTLSTGQDIWQKLS

SEQ ID NO: 1273 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDANASIGMKKYAVGVNANGKVAISAKKIEGDNIGAQVLGLFTLSTGQDQWQKLS

SEQ ID NO: 1274 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLGKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYAVGVNANGKVAISAKKIEGDNIGAQVLGLFTLSTGQDIWQKLS

SEQ ID NO: 1275 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLIAIYVTDSDTRASIGMKKYAVGVNANGKVAISAKKIEGDNIGAQVLGLFTLSTGQDIWQKLS

SEQ ID NO: 1276 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYVANQGWYDITKTFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELIAIYVTDSDTRASIGMKKYAVGVNANGKVAISAKKIEGDNIGAQVLGLFTLSTGQDQWQKLS

SEQ ID NO: 1277 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVMPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1278 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1279 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVMPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDANASIGMKKYAVGINAHGKVAISAKKIEGDNIGAQVLGLFTLSTGQDQWQKLS

SEQ ID NO: 1280 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1281 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDANASIGMKKYAVGINAHGKVAISAKKIEGDNIGAQVLGLFTLSTGQDIWQKLS

SEQ ID NO: 1282 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDANASIGMKKYAVGINAHGKVAISAKKIEGDNIGAQVLGLFTLSTGQDQWQKLS

SEQ ID NO: 1283 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFRDKAFPGLSARQLGVFPDLVLDMFINGYYLNLFKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDTRASIGMKKYAVGINAHGKVAISAKKIEGDNIGAQVLGLFTLSTGQDIWQKLS

SEQ ID NO: 1284 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGNLEAIYVTDSDTRASIGMKKYAVGINAHGKVAISAKKIEGDNIGAQVLGLFTLSTGQDIWQKLS

SEQ ID NO: 1285 - protein, 539 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGTITSVWTKGVTPPTPEDFREYNEDVLHAPYLANQGWYDITKAFDGKDNLLCGAATAGNMLHWWFDQNKEEIERYLKKHPEKQKIIFGNQELFDVKAAIDTKDSQTNSKLFNYFLDKAFPGLSARQLGVFPDLVLDMFINGYYLNLPKTQSTDVNRPYQDKDKRGGIFDAVFTRGVQTTLLTARHDLKNKGLNEISDLIKQELTEGKALALSHTYANVRINHVINLWGADFDAEGELEAIYVTDSDTRASIGMKKYAVGINAHGKVAISAKKIEGDNIGAQVLGLFTLSTGQDQWQKLS

SEQ ID NO: 1286 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISNNFNGPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1287 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDGQLKLSDFLNTYESDDGYRDKSKLFDFISENFNGPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1288 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDEQLKLSDFLNTYESDDGYRDKSKLFDFISNNFNKPVWTDKLLDNYINGYAYNSKYGRTIEDSTKNTSKINFFKEVFNEKILTNIHSIRNQNEFSVLLSEALYTGKAIGLSYGPAGLRHSLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1289 - protein, 574 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGSQTEDSESLQRLRDIEDFQAEKKKQNVVYTKWLDGVDVKDHDFRKIVDGNSAYYATPLLNGRGFYDINKDFNRDNDKCAAAVAANMFHYWLDRNRDNVDRFLRQNPEKHGIIELPDEQLKLSDFLNTYESDDGYRDKSKLFDFISENFNKPVWTDKLLDNYINGYAYNSKYGRTIEDSTKNTSKINFFKEVFNEKILTNIHSIRNQNEFSVLLIEALYTGKAIGLSYGPAGLRHGLGHIISVWGADLDADGNVVAIYVTDSDDKKLTIGDERVGLKRYKISTDDEGRLRLTAYEETHNTGGQVRGLWTLDTGKQAWADYFDKTEQTGTDQAEQ

SEQ ID NO: 1290 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWQQTN

SEQ ID NO: 1291 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1292 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1293 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTNSDSNPSIGMKKYFVGVNSSGKVAISAKEIEEDNIGAQVLGLFTLSTGQDIWQQTN

SEQ ID NO: 1294 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSNSNPSIGMKKYFVGVNSSGKVAISAKEIEEDNIGAQVLGLFTLSTGQDIWQQTN

SEQ ID NO: 1295 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWQQTN

SEQ ID NO: 1296 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1297 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1298 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTNSDSNPSIGMKKYFVGVNSSGKVAISAKEIEEDNIGAQVLGLFTLSTGQDIWQQTN

SEQ ID NO: 1299 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSNSNPSIGMKKYFVGVNSSGKVAISAKEIEEDNIGAQVLGLFTLSTGQDIWQQTN

SEQ ID NO: 1300 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTNSDSNPSIGMKKYFVGVNSSGKVAISAKEIEEDNIGAQVLGLFTLSTGQDIWQQTN

SEQ ID NO: 1301 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSNSNPSIGMKKYFVGVNSSGKVAISAKEIEEDNIGAQVLGLFTLSTGQDIWQQTN

SEQ ID NO: 1302 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWNQTN

SEQ ID NO: 1303 - protein, 292 aa, synthetic construct
VTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWNQTN

SEQ ID NO: 1304 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTNSDSNPSIGMKKYFVGVNSSGKVAISAKEIEEDNIGAQVLGLFTLSTGQDIWQQTN

SEQ ID NO: 1305 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSNSNPSIGMKKYFVGVNSSGKVAISAKEIEEDNIGAQVLGLFTLSTGQDIWQQTN

SEQ ID NO: 1306 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTNSDSNPSIGMKKYFVGVNSSGKVAISAKEIEEDNIGAQVLGLFTLSTGQDIWQQTN

SEQ ID NO: 1307 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSNSNPSIGMKKYFVGVNSSGKVAISAKEIEEDNIGAQVLGLFTLSTGQDIWQQTN

SEQ ID NO: 1308 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTNSDSNPSIGMKKYFVGVNSSGKVAISAKEIEEDNIGAQVLGLFTLSTGQDIWQQTN

SEQ ID NO: 1309 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSNSNPSIGMKKYFVGVNSSGKVAISAKEIEEDNIGAQVLGLFTLSTGQDIWQQTN

SEQ ID NO: 1310 - protein, 292 aa, synthetic construct
VTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWQQTN

SEQ ID NO: 1311 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1312 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWNQTN

SEQ ID NO: 1313 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTNSDSNPSIGMKKYFVGVNSSGKVAISAKEIEEDNIGAQVLGLFTLSTGQDIWQQTN

SEQ ID NO: 1314 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSNSNPSIGMKKYFVGVNSSGKVAISAKEIEEDNIGAQVLGLFTLSTGQDIWQQTN

SEQ ID NO: 1315 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTNSDSNPSIGMKKYFVGVNSSGKVAISAKEIEEDNIGAQVLGLFTLSTGQDIWQQTN

SEQ ID NO: 1316 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSNSNPSIGMKKYFVGVNSSGKVAISAKEIEEDNIGAQVLGLFTLSTGQDIWQQTN

SEQ ID NO: 1317 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWNQTN

SEQ ID NO: 1318 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWNQTN

SEQ ID NO: 1319 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTNSDSNPSIGMKKYFVGVNSSGKVAISAKEIEEDNIGAQVLGLFTLSTGQDIWQQTN

SEQ ID NO: 1320 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSNSNPSIGMKKYFVGVNSSGKVAISAKEIEEDNIGAQVLGLFTLSTGQDIWQQTN

SEQ ID NO: 1321 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTNSDSNPSIGMKKYFVGVNSSGKVAISAKEIEEDNIGAQVLGLFTLSTGQDIWQQTN

SEQ ID NO: 1322 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSNSNPSIGMKKYFVGVNSSGKVAISAKEIEEDNIGAQVLGLFTLSTGQDIWQQTN

SEQ ID NO: 1323 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1324 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIKNYLKKYPEKQKINFGGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWNQTN

SEQ ID NO: 1325 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTNSDSNPSIGMKKYFVGVNSSGKVAISAKEIEEDNIGAQVLGLFTLSTGQDIWQQTN

SEQ ID NO: 1326 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFNGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSNSNPSIGMKKYFVGVNSSGKVAISAKEIEEDNIGAQVLGLFTLSTGQDIWQQTN

SEQ ID NO: 1327 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTNSDSNPSIGMKKYFVGVNSSGKVAISAKEIEEDNIGAQVLGLFTLSTGQDIWQQTN

SEQ ID NO: 1328 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSNSNPSIGMKKYFVGVNSSGKVAISAKEIEEDNIGAQVLGLFTLSTGQDIWQQTN

SEQ ID NO: 1329 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRIGHVINLWGADFDAEGNLEAIYVTDSDSNPSIGMKKYFVGVNSSGKVAISAKEIEEDNIGAQVLGLFTLSTGQDIWQQTN

SEQ ID NO: 1330 - protein, 10 aa, synthetic construct
GGGSKGGGSK

SEQ ID NO: 1331 - protein, 349 aa, synthetic construct
MKTIAYPNKPHSLSAGLLTAIAIFSLASSNITYADDYQRNAAEVYAKEVPHQITSVWTKGVTPLTPEQFRYNNEDVIHAPYLAHQGWYDITKVFDGKDNLLCGAATAGNMLHWWFDQNKTEIEAYLSKHPEKQKIIFNNQELFDLKAAIDTKDSQTNSQLFNYFRDKAFPNLSARQLGVMPDLVLDMFINGYYLNVFKTQSTDVNRPYQDKDKRGGIFDAVFTRGDQTTLLTARHDLKNKGLNDISTIIKQELTEGRALALSHTYANVSISHVINLWGADFNAEGNLEAIYVTDSDANASIGMKKYFVGINAHGHVAISAKKIEGENIGAQVLGLFTLSSGKDIWQKLS

SEQ ID NO: 1332 - protein, 349 aa, synthetic construct
MKTIAYPNKPHSLSAGLLTAIAIFSLASSNITYADDYQRNATEAYAKEVPHQITSVWTKGVIPLIPEQFRYNNEDVIHAPYLAHQGWYDITKAFDGKDNLLCGAATAGNMLHWWFDQNKTEIEAYLSKHPEKQKIIFNNQELFDLKAAIDTKDSQINSQLFNYFRDKAFPNLSARQLGVMPDLVLDMFINGYYLNVFKIQSTDVNRPYQDKDKRGGIFDAVFIRGDQTILLTARHDLKNKGLNDISTIIKQELTEGRALALSHIYANVSISHVINLWGADFNAEGNLEAIYVIDSDANASIGMKKYFVGINAHGHVAISAKKIEGENIGAQVLGLFTLSSGKDIWQKLS

SEQ ID NO: 1333 - protein, 298 aa, synthetic construct
TITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVFPDLVLDMFINGYYLNGGKTQSTDVNRPYQDKDKRGGIFDAVFTRGDQTTLLTARHDLKNKGLNEISDLIKQELTEGKALALSHTYANVRINHVINLWGADFDAEGNLEAIYVTDSDANPSIGMKKYFVGVNAHGKVAISAKKIEGDNIGAQVLGLFTLSTGQDQWQKLS

SEQ ID NO: 1334 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANVRINHVINLWGADFDAEGNLEAIYVTDSDSNPSIGMKKYFVGVNSSGKVAISAKEIEEDNIGAQVLGLFTLSTGQDIWQQTN

SEQ ID NO: 1335 - protein, 528 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKVTSVWTKGVTPPTDFIYGEDVLHAPYKAGQGWYDITKLFNGKDDLLCGAATAGNMLHWWFDQNKEQIENYLKKYPEKQKINFKGEQLFDVKEAIDTKDSQLDSKLFDYFKEKAFPYLSTKHLGVFPDHVIDMFINGYRLSLTDHGPTPVKRGSKDPRGGIFDAVFTRGDQSKLLTNRYDLKEKTLKEISDLIKQELTEGKALGISHTYANGRINHVINLWGADFDAEGNLEAIYVTDSDSNPSIGMKKYFVGVNSSGKVAISAKEIEEDNIGAQVLGLFTLSTGQDIWQQTN

SEQ ID NO: 1336 - protein, 534 aa, synthetic construct
DKTHTCPPCPAPEAAGAPSVFLFPPKPKDTLMISRTPEVTCVVVDVSHEDPEVKFNWYVDGVEVHNAKTKPREEQQNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSKGGGSKTITSVWTKGVTPPTPEDFRENNEDVLHAPYLANQGWYDITKAFDGKDNLLCGAATAGNMLHWWFDQNKEEIERYLKKHPEKQKIIFGNQELFDVKAAIDTKDSQTNSKLFDYFRDKAFPNLSARQLGVFPDLVLDMFINGYYLNGGKTQSTDVNRPYQDKDKRGGIFDAVFTRGDQTTLLTARHDLKNKGLNEISDLIKQELTEGKALALSHTYANVRINHVINLWGADFDAEGNLEAIYVTDSDANPSIGMKKYFVGVNAHGKVAISAKKIEGDNIGAQVLGLFTLSTGQDQWQKLS

SEQ ID NO: 1337 - protein, 5 aa, synthetic construct
GGGGS

SEQ ID NO: 1338 - protein, 10 aa, synthetic construct
GGGGSGGGGS

SEQ ID NO: 1339 - protein, 15 aa, synthetic construct
GGGGSGGGGSGGGGS

SEQ ID NO: 1340 - protein, 20 aa, synthetic construct
GGGGSGGGGSGGGGSGGGGS

SEQ ID NO: 1341 - protein, 8 aa, synthetic construct
GGGGGGGG

SEQ ID NO: 1342 - protein, 6 aa, synthetic construct
GGGGGG

SEQ ID NO: 1343 - protein, 15 aa, synthetic construct
EAAAKEAAAKEAAAK

SEQ ID NO: 1344 - protein, 4 aa, synthetic construct
EAAK

SEQ ID NO: 1345 - protein, 8 aa, synthetic construct
EAAKEAAK

SEQ ID NO: 1346 - protein, 12 aa, synthetic construct
EAAKEAAKEAAK

SEQ ID NO: 1347 - protein, 46 aa, synthetic construct
AEAAAKEAAAKEAAAKEAAAKALEAEAAAKEAAAKEAAAKEAAAKA

SEQ ID NO: 1348 - protein, 12 aa, synthetic construct
AEAAAKEAAAKA

SEQ ID NO: 1349 - protein, 310 aa, synthetic construct
DSFSANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 1350 - protein, 4 aa, synthetic construct
DSFS

SEQ ID NO: 1351 - protein, 20 aa, synthetic construct
DSFSANQEIRYSEVTPYHVT

SEQ ID NO: 1352 - protein, 18 aa, synthetic construct
DSFSANQEIRYSEVTPYH

SEQ ID NO: 1353 - protein, 16 aa, synthetic construct
ANQEIRYSEVTPYHVT

SEQ ID NO: 1354 - protein, 14 aa, synthetic construct
ANQEIRYSEVTPYH

SEQ ID NO: 1355 - protein, 4 aa, synthetic construct
NQTN

SEQ ID NO: 1356 - protein, 4 aa, synthetic construct
QQTN

SEQ ID NO: 1357 - protein, 20 aa, synthetic construct
METDTLLLWVLLLWVPGSTG

SEQ ID NO: 1358 - protein, 19 aa, synthetic construct
MGWSCIILFLVATATGVHS

What is claimed:

1. A polypeptide comprising the amino acid sequence of SEQ ID NO: 1303.

2. The polypeptide of claim 1, wherein the polypeptide is linked to a polypeptide having the amino acid sequence of SEQ ID NO: 23.

3. The polypeptide of claim 2, wherein the polypeptide is linked to the amino acid sequence of SEQ ID NO: 23 with a peptide linker.

4. The polypeptide of claim 3, wherein the peptide linker is a charged peptide linker.

5. The polypeptide of claim 3, wherein the peptide linker comprises the amino acid sequence of SEQ ID NO: 1330.

6. A polypeptide comprising the amino acid sequence of SEQ ID NO: 1318.

7. A pharmaceutical composition comprising the polypeptide of claim 1 and a pharmaceutically acceptable excipient.

8. A pharmaceutical composition comprising the polypeptide of claim 6 and a pharmaceutically acceptable excipient.

9. The pharmaceutical composition of claim 8, wherein the pharmaceutical composition comprises a dimer of the polypeptide.

10. The pharmaceutical composition of claim 9, wherein the dimer comprises a first polypeptide comprising the amino acid sequence of SEQ ID NO: 1318 and a second polypeptide comprising the amino acid sequence of SEQ ID NO: 1318.

11. A method of reducing immunoglobulins in a subject, the method comprising administering to the subject the polypeptide of claim 1, or a pharmaceutical composition comprising the polypeptide.

12. A method of reducing immunoglobulins in a subject, the method comprising administering to the subject the polypeptide of claim 6, or a pharmaceutical composition comprising the polypeptide.

13. A pharmaceutical composition comprising the polypeptide of claim 2 and a pharmaceutically acceptable excipient.

14. A pharmaceutical composition comprising the polypeptide of claim 3 and a pharmaceutically acceptable excipient.

15. A pharmaceutical composition comprising the polypeptide of claim 4 and a pharmaceutically acceptable excipient.

16. A pharmaceutical composition comprising the polypeptide of claim 5 and a pharmaceutically acceptable excipient.

17. A pharmaceutical composition comprising a polypeptide dimer, wherein the dimer comprises a first polypeptide comprising the amino acid sequence of SEQ ID NO: 1303 and a second polypeptide comprising the amino acid sequence of SEQ ID NO: 1303.

18. A method of reducing immunoglobulins in a subject, the method comprising administering to the subject the polypeptide of claim 2, or a pharmaceutical composition comprising the polypeptide.

19. A method of reducing immunoglobulins in a subject, the method comprising administering to the subject the polypeptide of claim 3, or a pharmaceutical composition comprising the polypeptide.

20. A method of reducing immunoglobulins in a subject, the method comprising administering to the subject the polypeptide of claim 4, or a pharmaceutical composition comprising the polypeptide.

21. A method of reducing immunoglobulins in a subject, the method comprising administering to the subject the polypeptide of claim 5, or a pharmaceutical composition comprising the polypeptide.

22. A method of reducing immunoglobulins in a subject, the method comprising administering to the subject the polypeptide of claim 8.

23. A method of reducing immunoglobulins in a subject, the method comprising administering to the subject the pharmaceutical composition of claim 9.

24. A method of reducing immunoglobulins in a subject, the method comprising administering to the subject the pharmaceutical composition of claim 10.

25. A method of reducing immunoglobulins in a subject, the method comprising administering to the subject the pharmaceutical composition of claim 17.

* * * * *